United States Patent 11,446,398 (REGULATED BIOCIRCUIT SYSTEMS) - sequence listing, part 59

SEQ ID NO: 154883 - DNA, 3381 bp, Homo sapiens
  Payload ID: 10453
  Gene Symbol: MAPK8IP2
  Gene Name: mitogen-activated protein kinase 8 interacting protein 2
  Uniprot ID: Q13387
  ENST ID: ENST00000329492
  CDS Start-End: 135-2609
ggagtccgggcgaggtgcgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgcgcgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaca

SEQ ID NO: 154884 - DNA, 5661 bp, Homo sapiens
  Payload ID: 10454
  Gene Symbol: MAPK8IP3
  Gene Name: mitogen-activated protein kinase 8 interacting protein 3
  Uniprot ID: Q9UPT6
  ENST ID: ENST00000250894
  CDS Start-End: 158-4168
agtgacgggcgcagcctcggcagcggcggcggcggagccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcagtgcgcgatgatttctttggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatgggagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggaacttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggagctggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgcttccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 154885 - DNA, 4456 bp, Homo sapiens
  Payload ID: 10454
  Gene Symbol: MAPK8IP3
  Gene Name: mitogen-activated protein kinase 8 interacting protein 3
  ENST ID: ENST00000356010
  CDS Start-End: 148-4140
gcagcctcggcagcggcggcggcggagccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatgggagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggaacttccacccgaggggaagatgctctcgggacagtttcccgggcagctcctggccagcttccagcccagagtcctcaagtccagggcaccttgggcccagcgcaggcagaatccgaggtgg

SEQ ID NO: 154886 - DNA, 551 bp, Homo sapiens
  Payload ID: 10454
  Gene Symbol: MAPK8IP3
  Gene Name: mitogen-activated protein kinase 8 interacting protein 3
  ENST ID: ENST00000567849
  CDS Start-End: 1-208
gcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaggcggaagtgcaggcgcccctggcaaggccccttcacgtacctgtatgccg

SEQ ID NO: 154887 - DNA, 5626 bp, Homo sapiens
  Payload ID: 10454
  Gene Symbol: MAPK8IP3
  Gene Name: mitogen-activated protein kinase 8 interacting protein 3
  ENST ID: ENST00000610761
  CDS Start-End: 121-4134
ccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggagcaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcagtgcgcgatgatttctttggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatgggagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggaacttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggagctggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgcttccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgt

SEQ ID NO: 154888 - DNA, 1509 bp, Homo sapiens
  Payload ID: 10455
  Gene Symbol: MAPK9
  Gene Name: mitogen-activated protein kinase 9
  ENST ID: ENST00000347470
  CDS Start-End: 293-1312
gggtctgtcagaccgggcgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgcaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaa

SEQ ID NO: 154889 - DNA, 4369 bp, Homo sapiens
  Payload ID: 10455
  Gene Symbol: MAPK9
  Gene Name: mitogen-activated protein kinase 9
  Uniprot ID: P45984
  ENST ID: ENST00000343111
  CDS Start-End: 300-1448
ggcgcgagggtctgtcagaccgggcgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgtggacatctggtctgtcgggtgcatcatggcagaaatggtcctccataaagtcctgttcccgggaagagactatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 154890 - DNA, 4326 bp, Homo sapiens
  Payload ID: 10455
  Gene Symbol: MAPK9
  Gene Name: mitogen-activated protein kinase 9
  Uniprot ID: P45984
  ENST ID: ENST00000393360
  CDS Start-End: 257-1405
gcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 154891 - DNA, 1344 bp, Homo sapiens
  Payload ID: 10455
  Gene Symbol: MAPK9
  Gene Name: mitogen-activated protein kinase 9
  ENST ID: ENST00000393362
  CDS Start-End: 238-612
cggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagcccagaacgtcagaatcgttagtctgaccctgaacgttagtctcttgcatggtaagacggtcagccgccgcagcatcacgggccagctcaagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaat

SEQ ID NO: 154892 - DNA, 1416 bp, Homo sapiens
  Payload ID: 10455
  Gene Symbol: MAPK9
  Gene Name: mitogen-activated protein kinase 9
  ENST ID: ENST00000397072
  CDS Start-End: 21-395
atattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagcccagaacgtcagaatcgttagtctgaccctgaacgttagtctcttgcatggtaagacggtcagccgccgcagcatcacgggccagctcaagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcaggttagtgattgctttaattgatt

SEQ ID NO: 154893 - DNA, 4336 bp, Homo sapiens
  Payload ID: 10455
  Gene Symbol: MAPK9
  Gene Name: mitogen-activated protein kinase 9
  Uniprot ID: P45984
  ENST ID: ENST00000455781
  CDS Start-End: 272-1546
gcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgtggacatctggtctgtcgggtgcatcatggcagaaatggtcctccataaagtcctgttcccgggaagagactatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 154894 - DNA, 4815 bp, Homo sapiens
  Payload ID: 10455
  Gene Symbol: MAPK9
  Gene Name: mitogen-activated protein kinase 9
  Uniprot ID: P45984
  ENST ID: ENST00000452135
  CDS Start-End: 300-1574
ggcgcgagggtctgtcagaccgggcgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaatgtatagcatgtccaatttttgtgtgtttttacatggcaattagatatttctccatcaccatctctgatgacagatttaacatgaacacagatagatgataaagtgtcatgcttttgatcaatattagcaagaggtttcacactgagaggcagaaacattgctgtttgttctcttattgaaaatattctgcaaattcctaaatctgtgttttcaaaactaatggcagtaagttttgacttcaccaatatgcaggtccaattcagagtattggtgtaattgttttctcatgaggcgtggccaggagaattcaccagtcagccttagtcatgttacttaacgtcattcatggtgcttgtggctttgtgcctgggatgagccaagttcatctgacgtctgtgtttgaagcacttcaggctgtttagtacttaataccacaggagtggaaggaca

SEQ ID NO: 154895 - DNA, 2266 bp, Homo sapiens
  Payload ID: 10455
  Gene Symbol: MAPK9
  Gene Name: mitogen-activated protein kinase 9
  Uniprot ID: P45984
  ENST ID: ENST00000425491
  CDS Start-End: 168-896
ggagcggagcggggcgggccggcggcggagccggggccgcggagccaggagtgactagcacgcagcgccgccagtccgcccgcccgccctctccccgtggcgcggcggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttgggcagattgatggttgcttttaaggaaatcaagctccatagtcagtgttttgtatgtatcttaggaaaataatttcagattttaataattttatcaaagtggtctccttataaattcttcacagtgcaaacttaaagtgaaaatatttttatttctctcattttatttacctttctttacattttctatatcatagattatataatatgtcaagttattttatttgttctactaaattttctagcagtttccatagcctcatctcagattcacttgttgcaacctataaataaggacgtctttattttgcaagtaaacttaattaaaaagggaaaagttgaaaaattaaaagactaataatttagaaatatctacttaatgttcagtttgtctcaattcttactcattttgtgccattccttgttttattacaaaatgttttcttcaaaaagtacaaaaatgaaaaatgtgagtactttttggtgcattttagtaagtaaaattaaaattcctgctata

SEQ ID NO: 154896 - DNA, 657 bp, Homo sapiens
  Payload ID: 10455
  Gene Symbol: MAPK9
  Gene Name: mitogen-activated protein kinase 9
  ENST ID: ENST00000523583
  CDS Start-End: 347-657
gagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcggcggggaggcgaggaatgttatatgcatggagttatacaggatgtgactttttgagattggcttttttcgttgactatcctgcccctgagatccacccaagttgtgggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgt

SEQ ID NO: 154897 - DNA, 1668 bp, Homo sapiens
  Payload ID: 10455
  Gene Symbol: MAPK9
  Gene Name: mitogen-activated protein kinase 9
  ENST ID: ENST00000539014
  CDS Start-End: 21-665
atattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgctataaagtattggactctttggcactaaaaccccagattgctacaaaccgaaggctaaaatagagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttggg

SEQ ID NO: 154898 - DNA, 3395 bp, Homo sapiens
  Payload ID: 10456
  Gene Symbol: MAPKAP1
  Gene Name: mitogen-activated protein kinase associated protein 1
  Uniprot ID: Q9BPZ7
  ENST ID: ENST00000265960
  CDS Start-End: 334-1902
tccggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 154899 - DNA, 3256 bp, Homo sapiens
  Payload ID: 10456
  Gene Symbol: MAPKAP1
  Gene Name: mitogen-activated protein kinase associated protein 1
  Uniprot ID: Q9BPZ7
  ENST ID: ENST00000350766
  CDS Start-End: 303-1763
gtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 154900 - DNA, 693 bp, Homo sapiens
  Payload ID: 10456
  Gene Symbol: MAPKAP1
  Gene Name: mitogen-activated protein kinase associated protein 1
  ENST ID: ENST00000373496
  CDS Start-End: 298-693
gctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatgctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtat

SEQ ID NO: 154901 - DNA, 3131 bp, Homo sapiens
  Payload ID: 10456
  Gene Symbol: MAPKAP1
  Gene Name: mitogen-activated protein kinase associated protein 1
  Uniprot ID: Q9BPZ7
  ENST ID: ENST00000373498
  CDS Start-End: 70-1638
gtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 154902 - DNA, 3045 bp, Homo sapiens
  Payload ID: 10456
  Gene Symbol: MAPKAP1
  Gene Name: mitogen-activated protein kinase associated protein 1
  Uniprot ID: Q9BPZ7
  ENST ID: ENST00000373503
  CDS Start-End: 560-1552
ccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 154903 - DNA, 3252 bp, Homo sapiens
  Payload ID: 10456
  Gene Symbol: MAPKAP1
  Gene Name: mitogen-activated protein kinase associated protein 1
  Uniprot ID: Q9BPZ7
  ENST ID: ENST00000373511
  CDS Start-End: 331-1758
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacacac

SEQ ID NO: 154904 - DNA, 1586 bp, Homo sapiens
  Payload ID: 10456
  Gene Symbol: MAPKAP1
  Gene Name: mitogen-activated protein kinase associated protein 1
  Uniprot ID: Q9BPZ7
  ENST ID: ENST00000394060
  CDS Start-End: 331-1302
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggtgcttgtgactaaattcactaatttcactggctgtcaaggctgtgttaaggaaaatgggtttgaactgctgtgggttttgagtactggactggatgtcagaaacctttgccatcacgggaaattctgtcactctggatttactgtctgttccccacagctaaattcctctgcagtgtgatttagcaccctggatccccatcaaccagttttggcatttatttgaatgcattaccccactggtttccataaactattttacaattgtttaaaataaatgactgtttatttccacaaaa

SEQ ID NO: 154905 - DNA, 2977 bp, Homo sapiens
  Payload ID: 10456
  Gene Symbol: MAPKAP1
  Gene Name: mitogen-activated protein kinase associated protein 1
  Uniprot ID: Q9BPZ7
  ENST ID: ENST00000394063
  CDS Start-End: 492-1484
tccggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 154906 - DNA, 769 bp, Homo sapiens
  Payload ID: 10456
  Gene Symbol: MAPKAP1
  Gene Name: mitogen-activated protein kinase associated protein 1
  ENST ID: ENST00000433483
  CDS Start-End: 490-769
tgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagggttcttgctctattgaccaggctggagtgcagtggcacgatcacggctcactgcagcctcaacttcctggactcaagcgatcctcccacctcttcctccccagcagctgggactacaggcatgcactaccacggcctcccaaattgttgggattgtaagcatgaaccactgcatctggccaggcctggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactcc

SEQ ID NO: 154907 - DNA, 984 bp, Homo sapiens
  Payload ID: 10456
  Gene Symbol: MAPKAP1
  Gene Name: mitogen-activated protein kinase associated protein 1
  ENST ID: ENST00000420643
  CDS Start-End: 226-984
agccctagggtgaagtagatcgtggtgaaaagtgaagctctgggggaagaccgggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaag

SEQ ID NO: 154908 - DNA, 816 bp, Homo sapiens
  Payload ID: 10456
  Gene Symbol: MAPKAP1
  Gene Name: mitogen-activated protein kinase associated protein 1
  ENST ID: ENST00000427078
  CDS Start-End: 435-816
gctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcag

SEQ ID NO: 154909 - DNA, 701 bp, Homo sapiens
  Payload ID: 10456
  Gene Symbol: MAPKAP1
  Gene Name: mitogen-activated protein kinase associated protein 1
  ENST ID: ENST00000444226
  CDS Start-End: 1-283
caagtcattcaaagtcagcatgatccacagactgcgattcacaaccgacgtacagctaggtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatca

SEQ ID NO: 154910 - DNA, 401 bp, Homo sapiens
  Payload ID: 10456
  Gene Symbol: MAPKAP1
  Gene Name: mitogen-activated protein kinase associated protein 1
  ENST ID: ENST00000468896
  CDS Start-End: 1-401
gaacagtgccctctgcagctgaataacccttttaacgagtattccaaatttgatggcaagcattgttccagtctatgtcggataattatgaacaaatgttttctacaatcattggcattaaatagctctcttcaaagaaagtcacttaaaactttgcagaaaagcatgaagccaccgagaaatgttgcaaactcagaaaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgca

SEQ ID NO: 154911 - DNA, 1495 bp, Homo sapiens
  Payload ID: 10456
  Gene Symbol: MAPKAP1
  Gene Name: mitogen-activated protein kinase associated protein 1
  ENST ID: ENST00000497932
  CDS Start-End: 216-953
aacgatgcttccttggcgtgtccacaggcagaaaggagtaagctgacaaacatagcatgatatttcttaattcaagattattttgaactgaatcccatctgtattcttattgcttctcctactttggaaactatcagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccaggttccgctcatcactccttgcagagagcaagagggggctgtctgctgtggctgtccaccgtgcctcggcccagtgattaactttgcagctgtgtcattgttcaagtccaaacacaagtgctccacagaacgttctctgccctctgttcccctctcctatggcgtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgctt

SEQ ID NO: 154912 - DNA, 7158 bp, Homo sapiens
  Payload ID: 10457
  Gene Symbol: MAPKBP1
  Gene Name: mitogen-activated protein kinase binding protein 1
  Uniprot ID: O60336
  ENST ID: ENST00000456763
  CDS Start-End: 197-4741
cgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaacatagacagcttcacaaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatctggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctactaaaaataaaaaaattagctgggcgtggtggtgggcgcctgtaatcccagctactcgggaggtttaggcaggagaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccttgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgtt

SEQ ID NO: 154913 - DNA, 7232 bp, Homo sapiens
  Payload ID: 10457
  Gene Symbol: MAPKBP1
  Gene Name: mitogen-activated protein kinase binding protein 1
  Uniprot ID: O60336
  ENST ID: ENST00000457542
  CDS Start-End: 287-4813
ggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatctggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctactaaaaataaaaaaattagctgggcgtggtggtgggcgcctgtaatcccagctactcgggaggtttaggcaggagaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccttgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgttaa

SEQ ID NO: 154914 - DNA, 4695 bp, Homo sapiens
  Payload ID: 10457
  Gene Symbol: MAPKBP1
  Gene Name: mitogen-activated protein kinase binding protein 1
  ENST ID: ENST00000505373
  CDS Start-End: 228-437
gtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctg

SEQ ID NO: 154915 - DNA, 908 bp, Homo sapiens
  Payload ID: 10457
  Gene Symbol: MAPKBP1
  Gene Name: mitogen-activated protein kinase binding protein 1
  ENST ID: ENST00000510535
  CDS Start-End: 440-908
agagcgagctctggaggatagggagtgggggagggaggctcccgtggcagaacgagttgtgggctacggcgagccccgccgcgtccccgccggcgctagcgcaggtgtccaggcctgcggaaatccctggtggtctcggcggcctcctcccttggacactacagttgccatgggaacagttgggcattaacgggaaccagatcgtccacgagaccaactggggcccatcccatccatctcgccagttaaacgcctctggcgggcgtgggcctggcatttcttcgtggcttaggattttccccccctttttcgtgagcctttccttccgacgttgtaagaaactgtgcagggctagaaggtggggatgagggaaatggtgagagcaatacccagaggtaaaagctgcagacttcgctaggcagaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatg

SEQ ID NO: 154916 - DNA, 5394 bp, Homo sapiens
  Payload ID: 10457
  Gene Symbol: MAPKBP1
  Gene Name: mitogen-activated protein kinase binding protein 1
  Uniprot ID: O60336
  ENST ID: ENST00000514566
  CDS Start-End: 179-3874
ggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctgagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatctggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgaga

SEQ ID NO: 154917 - DNA, 4804 bp, Homo sapiens
  Payload ID: 10457
  Gene Symbol: MAPKBP1
  Gene Name: mitogen-activated protein kinase binding protein 1
  ENST ID: ENST00000512970
  CDS Start-End: 287-1282
ggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctga

SEQ ID NO: 154918 - DNA, 210 bp, Homo sapiens
  Payload ID: 10457
  Gene Symbol: MAPKBP1
  Gene Name: mitogen-activated protein kinase binding protein 1
  ENST ID: ENST00000627631
  CDS Start-End: 1-210
atggctgtggaagggtcaaccattaccagccggatcaagaatctgttgagatctccatccatcaaactgcgcaggagtaaggcaggaaaccgacgagaggacctcagctccaaggtgtgtggttgtgttgttcaatccccggaaacacaaacagcaccacatcctcaacagttccaggaaaaccatcactgcccttgccttctcccctga

SEQ ID NO: 154919 - DNA, 3410 bp, Homo sapiens
  Payload ID: 10458
  Gene Symbol: MAP2K1
  Gene Name: mitogen-activated protein kinase kinase 1
  Uniprot ID: Q02750
  ENST ID: ENST00000307102
  CDS Start-End: 532-1713
gaggcaataggggcggagccgagtgggagtgtggaaagcgccgcatcccgggtgggaggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgcgcgcgaagccgagtcccgggcgggtggggcgggggtccactgagaccgctaccggcccctcggcgctgacgggaccgcgcggggcgcacccgctgaaggcagccccggggcccgcggcccggacttggtcctgcgcagcgggcgcggggcagcgcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagctacttttgcttttgtggtaagcttttcagtttctttagtacacaagaaatactggtttagccaagcaacactggtgagggggaaaggtgaagatgaggaggaggctggaaggcagaaacaggacaccgagttcagtgctttggactaatggggcttcctgtaatttcaatctctggactcagtccagctcttctcacccaacacccttatctgtgactcttccaaccaccttccttgtgggacctgtgaatagatcctgtatattcctttgatctcttttatacaagggaaaagcagctgatgggggactgggagcaaatctgagaaaaatgacaaaacatttcttatctcacagaacatttctcattttccatataccaatagttgagctgagggcctgcctgcacttttaggctgtcatgctcataggagggccttgctggtggccagcttgcctacctggtgtgggagctttctgcacaacataggacagtctgtctcctttgcgacattaagcaatggtttcccttctttcaccacttacacttaaccacaccttcctggaaaggaggaatgtgcctggcgctggctttgtcatgcctgtgaggtggcagtgatgtcacaaagccattgggaacttcttttaggtacatttgaggctgctggtcaatacctctccgctcattattttctttgaaagggcaggttacagaaactaaagccaacatatatatttataaataaaaggcccattcctttttagattaaaa

SEQ ID NO: 154920 - DNA, 1432 bp, Homo sapiens
  Payload ID: 10458
  Gene Symbol: MAP2K1
  Gene Name: mitogen-activated protein kinase kinase 1
  ENST ID: ENST00000566326
  CDS Start-End: 51-704
gtcttctccagaagccctggaagaatgaactgtaaggcctggactatggaatggtacctgtgcaccagcaattcctgagcaagcagcacaatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattatttt

SEQ ID NO: 154921 - DNA, 1734 bp, Homo sapiens
  Payload ID: 10459
  Gene Symbol: MAP2K2
  Gene Name: mitogen-activated protein kinase kinase 2
  Uniprot ID: P36507
  ENST ID: ENST00000262948
  CDS Start-End: 255-1457
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaa

SEQ ID NO: 154922 - DNA, 1471 bp, Homo sapiens
  Payload ID: 10459
  Gene Symbol: MAP2K2
  Gene Name: mitogen-activated protein kinase kinase 2
  ENST ID: ENST00000394867
  CDS Start-End: 295-1206
ggactcgggctgcggcgtcagccttcttcgggcctcggcagcggtagcggctcgctcgcctcaggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggag

SEQ ID NO: 154923 - DNA, 314 bp, Homo sapiens
  Payload ID: 10459
  Gene Symbol: MAP2K2
  Gene Name: mitogen-activated protein kinase kinase 2
  ENST ID: ENST00000599021
  CDS Start-End: 1-313
ccttcgtgggcacgcgctcctacatggctgtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgac

SEQ ID NO: 154924 - DNA, 1246 bp, Homo sapiens
  Payload ID: 10460
  Gene Symbol: MAP2K3
  Gene Name: mitogen-activated protein kinase kinase 3
  Uniprot ID: P46734
  ENST ID: ENST00000316920
  CDS Start-End: 210-1166
gttggcccgtgtgaggagaaggccggggcagcggaggcttccggcgagaggctggtcatatccatggtgaccatttatgggccacaacaggtccccatctgcgcagtgaaccctgtgctgagcaccttgcagacgtgatcttgcttcgtcctgcagcactgtgcggggcaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataa

SEQ ID NO: 154925 - DNA, 2303 bp, Homo sapiens
  Payload ID: 10460
  Gene Symbol: MAP2K3
  Gene Name: mitogen-activated protein kinase kinase 3
  Uniprot ID: P46734
  ENST ID: ENST00000342679
  CDS Start-End: 250-1293
agtcagcgcagttcggccggggtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaggactaaa

SEQ ID NO: 154926 - DNA, 2034 bp, Homo sapiens
  Payload ID: 10460
  Gene Symbol: MAP2K3
  Gene Name: mitogen-activated protein kinase kinase 3
  Uniprot ID: P46734
  ENST ID: ENST00000361818
  CDS Start-End: 95-1051
aaagttctcagttggcccgtgtgaggagaaggccggggcagcggaggcttccggcggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaatt

SEQ ID NO: 154927 - DNA, 2401 bp, Homo sapiens
  Payload ID: 10460
  Gene Symbol: MAP2K3
  Gene Name: mitogen-activated protein kinase kinase 3
  ENST ID: ENST00000395491
  CDS Start-End: 250-390
agtcagcgcagttcggccggggtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaagagaggctggtcatatccatggtgaccatttatgggccacaacaggtccccatctgcgcagtgaaccctgtgctgagcaccttgcagacgtgatcttgcttcgtcctgcagcactgtgcggggcaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaatt

SEQ ID NO: 154928 - DNA, 514 bp, Homo sapiens
  Payload ID: 10460
  Gene Symbol: MAP2K3
  Gene Name: mitogen-activated protein kinase kinase 3
  ENST ID: ENST00000529517
  CDS Start-End: 212-514
cagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaactctctgtcagccaacccatggcccagcgcccaaagggagcaaagttctcagttggcccgtgtgaggagaaggccggggcagcggaggcttccggcggccggtggatgcagaggccagtccatataccacccaggcctgcgaggagcgtggtccccacccatccagcccatatgtgcaagtgcccttgacagagaggctggtcatatccatggtgaccatttatgggccacaacaggtccccatctgcgc

SEQ ID NO: 154929 - DNA, 575 bp, Homo sapiens
  Payload ID: 10460
  Gene Symbol: MAP2K3
  Gene Name: mitogen-activated protein kinase kinase 3
  ENST ID: ENST00000526076
  CDS Start-End: 95-575
aaagttctcagttggcccgtgtgaggagaaggccggggcagcggaggcttccggcggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagag

SEQ ID NO: 154930 - DNA, 535 bp, Homo sapiens
  Payload ID: 10460
  Gene Symbol: MAP2K3
  Gene Name: mitogen-activated protein kinase kinase 3
  ENST ID: ENST00000527123
  CDS Start-End: 1-411
attgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggtgagtatgggcgggaggtgcctgccctgctcttcagggctggctggggctgggtggggctctggggagagggctgcatcctgcacacagatgggtagctcctctggctggccctgtgttctctcctttaggtgctcggtcatttgtttgctcctgcatacctggctccctcctccctccttcctgcatgccaggccctgggaagggtacacaggcagtgtgtgacagaatggggcagaggggccaagggtggcatcagggaaggcttcatggaggaggtaccatttgaactgagcctggaaggatgaataagggttatctcctgatggagaggctgtcccaagcagaa

SEQ ID NO: 154931 - DNA, 511 bp, Homo sapiens
  Payload ID: 10460
  Gene Symbol: MAP2K3
  Gene Name: mitogen-activated protein kinase kinase 3
  ENST ID: ENST00000483928
  CDS Start-End: 211-351
agtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggccggtggatgcagaggccagtccatataccacccaggcctgcgaggagcgtggtccccacccatccagcccatatgtgcaagtgcccttgacagagaggctggtcatatccatggtgaccatttatgggccacaacaggtccccatctgcgcagtgaaccctgtgctgagcaccttgcagacgtgatcttgcttcgtcctgcagcactgtgcggggcaggaaaatccaagaggaagaaggatctacggata

SEQ ID NO: 154932 - DNA, 574 bp, Homo sapiens
  Payload ID: 10460
  Gene Symbol: MAP2K3
  Gene Name: mitogen-activated protein kinase kinase 3
  ENST ID: ENST00000479129
  CDS Start-End: 211-351
agtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggccggtggatgcagaggccagtccatataccacccaggcctgcgaggagcgtggtccccacccatccagcccatatgtgcaagtgcccttgacaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcat

SEQ ID NO: 154933 - DNA, 2089 bp, Homo sapiens
  Payload ID: 10460
  Gene Symbol: MAP2K3
  Gene Name: mitogen-activated protein kinase kinase 3
  ENST ID: ENST00000496046
  CDS Start-End: 100-621
gcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaa

SEQ ID NO: 154934 - DNA, 2029 bp, Homo sapiens
  Payload ID: 10460
  Gene Symbol: MAP2K3
  Gene Name: mitogen-activated protein kinase kinase 3
  Uniprot ID: P46734
  ENST ID: ENST00000613338
  CDS Start-End: 338-1294
tggctggcaatggccttgctgacctcgagccgggcccacgtggggacctttggagcacagcctacgatcctggtgcaaggccggtggatgcagaggccagtccatataccacccaggcctgcgaggagcgtggtccccacccatccagcccatatgtgcaagtgcccttgacagagaggctggtcatatccatggtgaccatttatgggccacaacaggtccccatctgcgcagtgaaccctgtgctgagcaccttgcagacgtgatcttgcttcgtcctgcagcactgtgcggggcaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctaggg

SEQ ID NO: 154935 - DNA, 351 bp, Homo sapiens
  Payload ID: 10460
  Gene Symbol: MAP2K3
  Gene Name: mitogen-activated protein kinase kinase 3
  ENST ID: ENST00000627447
  CDS Start-End: 211-351
agtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggccggtggatgcagaggccagtccatataccacccaggcctgcgaggagcgtggtccccacccatccagcccatatgtgcaagtgcccttga

SEQ ID NO: 154936 - DNA, 3826 bp, Homo sapiens
  Payload ID: 10461
  Gene Symbol: MAP2K4
  Gene Name: mitogen-activated protein kinase kinase 4
  Uniprot ID: P45985
  ENST ID: ENST00000353533
  CDS Start-End: 64-1263
gcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagg

SEQ ID NO: 154937 - DNA, 3856 bp, Homo sapiens
  Payload ID: 10461
  Gene Symbol: MAP2K4
  Gene Name: mitogen-activated protein kinase kinase 4
  Uniprot ID: P45985
  ENST ID: ENST00000415385
  CDS Start-End: 54-1286
gagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggctttcagataaacttctgtgaaaaggcacaaagtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagggaaaatg

SEQ ID NO: 154938 - DNA, 551 bp, Homo sapiens
  Payload ID: 10461
  Gene Symbol: MAP2K4
  Gene Name: mitogen-activated protein kinase kinase 4
  ENST ID: ENST00000582183
  CDS Start-End: 59-196
aggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcaggagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactct

SEQ ID NO: 154939 - DNA, 925 bp, Homo sapiens
  Payload ID: 10461
  Gene Symbol: MAP2K4
  Gene Name: mitogen-activated protein kinase kinase 4
  ENST ID: ENST00000538465
  CDS Start-End: 1-49
ccacccggccgtcagcagcatgcaggagaattcggtcaacagtggatgaaaaagaacaaaaacaacttcttatggatttggatgtagtaatgcggagtagtgattgcccatacattgttcagttttatggtgcactcttcagagagactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcaga

SEQ ID NO: 154940 - DNA, 977 bp, Homo sapiens
  Payload ID: 10461
  Gene Symbol: MAP2K4
  Gene Name: mitogen-activated protein kinase kinase 4
  ENST ID: ENST00000602686
  CDS Start-End: 1-126
atggcggctccgagcccgagcggcggcggcggctccgggggcggcagcggcagcggcacccccggccccgtagggtccccggcgccaggccacccggccgtcagcagcatgcaggagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattga

SEQ ID NO: 154941 - DNA, 1064 bp, Homo sapiens
  Payload ID: 10461
  Gene Symbol: MAP2K4
  Gene Name: mitogen-activated protein kinase kinase 4
  ENST ID: ENST00000602375
  CDS Start-End: 18-296
gctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactct

SEQ ID NO: 154942 - DNA, 948 bp, Homo sapiens
  Payload ID: 10461
  Gene Symbol: MAP2K4
  Gene Name: mitogen-activated protein kinase kinase 4
  ENST ID: ENST00000602537
  CDS Start-End: 1-126
atggcggctccgagcccgagcggcggcggcggctccgggggcggcagcggcagcggcacccccggccccgtagggtccccggcgccaggccacccggccgtcagcagcatgcaggagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattga

SEQ ID NO: 154943 - DNA, 1136 bp, Homo sapiens
  Payload ID: 10461
  Gene Symbol: MAP2K4
  Gene Name: mitogen-activated protein kinase kinase 4
  ENST ID: ENST00000602811
  CDS Start-End: 18-143
gctcttcactcccaacaatggcggctccgagcccgagcggcggcggcggctccgggggcggcagcggcagcggcacccccggccccgtagggtccccggcgccaggccacccggccgtcagcagcatgcaggagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactct

SEQ ID NO: 154944 - DNA, 961 bp, Homo sapiens
  Payload ID: 10461
  Gene Symbol: MAP2K4
  Gene Name: mitogen-activated protein kinase kinase 4
  ENST ID: ENST00000602305
  CDS Start-End: 18-155
gctcttcactcccaacaatggcggctccgagcccgagcggcggcggcggctccgggggcggcagcggcagcggcacccccggccccgtagggtccccggcgccaggccacccggccgtcagcagcatgcaggagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactct

SEQ ID NO: 154945 - DNA, 2347 bp, Homo sapiens
  Payload ID: 10462
  Gene Symbol: MAP2K5
  Gene Name: mitogen-activated protein kinase kinase 5
  Uniprot ID: Q13163
  ENST ID: ENST00000178640
  CDS Start-End: 628-1974
ctcctcctcctctcgccgctaccgccgtcgccgccgccgcagccgccgccagtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacagcctctgcc

SEQ ID NO: 154946 - DNA, 1491 bp, Homo sapiens
  Payload ID: 10462
  Gene Symbol: MAP2K5
  Gene Name: mitogen-activated protein kinase kinase 5
  ENST ID: ENST00000340972
  CDS Start-End: 352-1128
aaactgaatcacctgcagggtctgacgcctgcatggaatgatgagggaaatttaattttccaagcaaagtgtgaagtgtgtgccactccagcaaataaacgaagtcatccatgacagcttgtgatgaattgccgtatttatactgtatattttaatagcctcacactaatttaaattgagcacagagtaaattataattcagtcacttgactgcttatatttaacttgacaactcatccttatttgtcctggaggtgtagtggagagcagtggaaatgcaccaaggagatgagggatgcatgctcaaggcagaatgtacatattgagggccagagctagagatgaattttgatggaggactttgaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgac

SEQ ID NO: 154947 - DNA, 1783 bp, Homo sapiens
  Payload ID: 10462
  Gene Symbol: MAP2K5
  Gene Name: mitogen-activated protein kinase kinase 5
  Uniprot ID: Q13163
  ENST ID: ENST00000354498
  CDS Start-End: 184-1422
gaagttgcagccactctgctaagtgccctgcttggaaaggctgtgggctccctgctgagaaatactgcgagcggctttgtcagccggctgcctggtgccagttctgctgcagcctgggagggacactgtggcagagctcctggagagaaatgaggtttgcaggccattggagttggactggacatgatggagggtcactttccccagagcgatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtg

SEQ ID NO: 154948 - DNA, 1689 bp, Homo sapiens
  Payload ID: 10462
  Gene Symbol: MAP2K5
  Gene Name: mitogen-activated protein kinase kinase 5
  Uniprot ID: Q13163
  ENST ID: ENST00000395476
  CDS Start-End: 6-1322
ctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacagcc

SEQ ID NO: 154949 - DNA, 429 bp, Homo sapiens
  Payload ID: 10462
  Gene Symbol: MAP2K5
  Gene Name: mitogen-activated protein kinase kinase 5
  ENST ID: ENST00000439036
  CDS Start-End: 1-387
gatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaagtgaagtgtgtgccactccagcaaataaacgaagtcatccatgaca

SEQ ID NO: 154950 - DNA, 814 bp, Homo sapiens
  Payload ID: 10462
  Gene Symbol: MAP2K5
  Gene Name: mitogen-activated protein kinase kinase 5
  ENST ID: ENST00000559262
  CDS Start-End: 1-548
cctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagcaaacaaagacctgtgcacctgaaaaggggtaagagagtgaccacagtgaccacaaaagcacctgcagaaactatggattatcaatttatttattagtaattagtcatggtaatgagaaatcaagttgtgttttgaggttgattttttaaaacagctttattgatatataatttgcatgccataaaattcatctactcaattcagtgatttttagtaagtttataaagttgtgcaaccataaccataatccagttttagaacattttcatcaccccaaaaaagtgtcct

SEQ ID NO: 154951 - DNA, 412 bp, Homo sapiens
  Payload ID: 10462
  Gene Symbol: MAP2K5
  Gene Name: mitogen-activated protein kinase kinase 5
  ENST ID: ENST00000557869
  CDS Start-End: 1-150
cagtatggaattcattctgatgtctggagcttaggaatctcttttatggagcctctccagcttctgcagtgcattgttgatgaggattcgcccgtccttccagttggagagttctcggagccatttgtacatttcatcactcagtggtgagcccgtttacaaacatgccatgccctcaatgtaaatgatacatgccattaactcggcagctccgtgagaccttatggctctccctgcatccttttggagacaggagggacttcggggccttgggcagatggggcagcaaagctgaagaaattgtttaaattatgtaaacgttatttacacaaagggtcataagcatacttcagagcctttttcctgatttaataaactgctgaaagtcatgatacttctttaagcacaaata

SEQ ID NO: 154952 - DNA, 1851 bp, Homo sapiens
  Payload ID: 10463
  Gene Symbol: MAP2K6
  Gene Name: mitogen-activated protein kinase kinase 6
  ENST ID: ENST00000359094
  CDS Start-End: 152-358
tgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaaca

SEQ ID NO: 154953 - DNA, 632 bp, Homo sapiens
  Payload ID: 10463
  Gene Symbol: MAP2K6
  Gene Name: mitogen-activated protein kinase kinase 6
  ENST ID: ENST00000588110
  CDS Start-End: 249-632
ctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaatagagacaggatttcaccgtgtcggccaggatggtctccatctcctgacctcgtgattcgcccgtctcggcctcccaaagtgctgggactacaggcatgagccaccgcgcctgggcagaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtg

SEQ ID NO: 154954 - DNA, 669 bp, Homo sapiens
  Payload ID: 10463
  Gene Symbol: MAP2K6
  Gene Name: mitogen-activated protein kinase kinase 6
  ENST ID: ENST00000589295
  CDS Start-End: 417-669
acatagacccacttcccttctcccttcctgaagctgcaatttcctcggaacaatgagcttgcagaggtttgctgcaatccgaacttgaggagggggtggagtctgttcagttctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaagcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctaca

SEQ ID NO: 154955 - DNA, 1512 bp, Homo sapiens
  Payload ID: 10463
  Gene Symbol: MAP2K6
  Gene Name: mitogen-activated protein kinase kinase 6
  Uniprot ID: P52564
  ENST ID: ENST00000589647
  CDS Start-End: 410-1246
gcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactaggaggcagtaaattcagggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgag

SEQ ID NO: 154956 - DNA, 2870 bp, Homo sapiens
  Payload ID: 10463
  Gene Symbol: MAP2K6
  Gene Name: mitogen-activated protein kinase kinase 6
  Uniprot ID: P52564
  ENST ID: ENST00000590474
  CDS Start-End: 288-1292
gttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaaggacagagggttttgattttaaaaagaagaaaaaaaaaccttattttttctttcttggcctcaagttcaatatggagaggattgcttccctgaatcctctcttccttccccttttaga

SEQ ID NO: 154957 - DNA, 1509 bp, Homo sapiens
  Payload ID: 10463
  Gene Symbol: MAP2K6
  Gene Name: mitogen-activated protein kinase kinase 6
  Uniprot ID: P52564
  ENST ID: ENST00000613873
  CDS Start-End: 409-1245
gcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactaggaggcagtaaattcaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatg

SEQ ID NO: 154958 - DNA, 3361 bp, Homo sapiens
  Payload ID: 10464
  Gene Symbol: MAP2K7
  Gene Name: mitogen-activated protein kinase kinase 7
  Uniprot ID: O14733
  ENST ID: ENST00000397979
  CDS Start-End: 55-1314
ctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttcca

SEQ ID NO: 154959 - DNA, 3430 bp, Homo sapiens
  Payload ID: 10464
  Gene Symbol: MAP2K7
  Gene Name: mitogen-activated protein kinase kinase 7
  Uniprot ID: O14733
  ENST ID: ENST00000397981
  CDS Start-End: 103-1383
cggcggctcgacggggtcatccgggcgcaggcgcagtgcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttgccctgcccgtctccctcccaggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttcca

SEQ ID NO: 154960 - DNA, 3396 bp, Homo sapiens
  Payload ID: 10464
  Gene Symbol: MAP2K7
  Gene Name: mitogen-activated protein kinase kinase 7
  Uniprot ID: O14733
  ENST ID: ENST00000397983
  CDS Start-End: 61-1368
gtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccattattgtgatcactctaagccctgctcctgccccgtcccaacgagcagccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataa

SEQ ID NO: 154961 - DNA, 7011 bp, Homo sapiens
  Payload ID: 10465
  Gene Symbol: MAP3K1
  Gene Name: mitogen-activated protein kinase kinase kinase 1, E3 ubiquitin protein ligase
  Uniprot ID: Q13233
  ENST ID: ENST00000399503
  CDS Start-End: 1-4539
atggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaa

SEQ ID NO: 154962 - DNA, 3436 bp, Homo sapiens
  Payload ID: 10466
  Gene Symbol: MAP3K10
  Gene Name: mitogen-activated protein kinase kinase kinase 10
  Uniprot ID: Q02779
  ENST ID: ENST00000253055
  CDS Start-End: 289-3153
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggctttgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggacggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgcccccta

SEQ ID NO: 154963 - DNA, 682 bp, Homo sapiens
  Payload ID: 10466
  Gene Symbol: MAP3K10
  Gene Name: mitogen-activated protein kinase kinase kinase 10
  ENST ID: ENST00000594951
  CDS Start-End: 1-202
gaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccg

SEQ ID NO: 154964 - DNA, 2104 bp, Homo sapiens
  Payload ID: 10466
  Gene Symbol: MAP3K10
  Gene Name: mitogen-activated protein kinase kinase kinase 10
  ENST ID: ENST00000597986
  CDS Start-End: 1-543
ctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggctttgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggacggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatg

SEQ ID NO: 154965 - DNA, 739 bp, Homo sapiens
  Payload ID: 10466
  Gene Symbol: MAP3K10
  Gene Name: mitogen-activated protein kinase kinase kinase 10
  ENST ID: ENST00000593502
  CDS Start-End: 1-369
caagatcacggacttcggcctcgcccgcgagtggcacaagaccaccaagatgagcgctgcggggacctacgcctggatggcgccggagaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggctttgccagcctcaatgagatgggtaagagcctgggttcttgtaagggggtgggggttccctggccaaaggggtgagcctcctggggctgagcgaa

SEQ ID NO: 154966 - DNA, 3566 bp, Homo sapiens
  Payload ID: 10467
  Gene Symbol: MAP3K11
  Gene Name: mitogen-activated protein kinase kinase kinase 11
  Uniprot ID: Q16584
  ENST ID: ENST00000309100
  CDS Start-End: 487-3030
gaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccaca

SEQ ID NO: 154967 - DNA, 2139 bp, Homo sapiens
  Payload ID: 10467
  Gene Symbol: MAP3K11
  Gene Name: mitogen-activated protein kinase kinase kinase 11
  ENST ID: ENST00000524848
  CDS Start-End: 1-648
gacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctcccc

SEQ ID NO: 154968 - DNA, 1812 bp, Homo sapiens
  Payload ID: 10467
  Gene Symbol: MAP3K11
  Gene Name: mitogen-activated protein kinase kinase kinase 11
  ENST ID: ENST00000532507
  CDS Start-End: 486-1277
agtgggcggggccggccggcgccagggcatctccgactcagacgagtagctttccttatccagacccaggggctcaagaaagcagtgaggctggtcacagtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccac

SEQ ID NO: 154969 - DNA, 2830 bp, Homo sapiens
  Payload ID: 10467
  Gene Symbol: MAP3K11
  Gene Name: mitogen-activated protein kinase kinase kinase 11
  Uniprot ID: Q16584
  ENST ID: ENST00000530153
  CDS Start-End: 523-2295
attctccaggcccacgagtcacaggactgaccagccagcccggcctgggcctgacctcccccagttctccccaaaaggactccccctcccaagtgggagacctggcccaggcctcccagaaaggagaagtagggaccacgggaggaaagcggaagaggtgtgagctgcccaggccactcccaagccccacagaggccagcccagggagggagctggtggccaggtccctatcagaggccagggagccctaaaggggcactgagagcttcccccagtttcggggtctctggcccattctcctctgggtgacccctgacctcccatgcctgggatctacatcagacaccagaacagcagttcgagttgggacagttgaaagcacagagaggagcttggagagaaagcagaggatggggcttagcagctggcagagccaggagcggggaggtagcagaaagaccacaagtacaaagaagtcctgaaactttggttttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccac

SEQ ID NO: 154970 - DNA, 561 bp, Homo sapiens
  Payload ID: 10467
  Gene Symbol: MAP3K11
  Gene Name: mitogen-activated protein kinase kinase kinase 11
  ENST ID: ENST00000529839
  CDS Start-End: 272-561
caaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatgttttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagct

SEQ ID NO: 154971 - DNA, 571 bp, Homo sapiens
  Payload ID: 10467
  Gene Symbol: MAP3K11
  Gene Name: mitogen-activated protein kinase kinase kinase 11
  ENST ID: ENST00000526293
  CDS Start-End: 238-571
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatgcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcagg

SEQ ID NO: 154972 - DNA, 4319 bp, Homo sapiens
  Payload ID: 10468
  Gene Symbol: MAP3K12
  Gene Name: mitogen-activated protein kinase kinase kinase 12
  Uniprot ID: Q12852
  ENST ID: ENST00000267079
  CDS Start-End: 227-2806
agaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccatgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaacatcttaaccggaataaaggcttccattcaaaacccaagaagggtcctttgagggataaaaggtacaaaaataacagcaagacaagaggaataaaacccacatgaatcactgtggcatccagtttctattcacaaagaaaaagctccagtccatcttttaatttttttgaaaaattcctgacattacagaactaaactgaaatgtattaatattccactcttacatttccatgacaaacagaaaaattcatgagccaaaaaaaaaaaacca

SEQ ID NO: 154973 - DNA, 3109 bp, Homo sapiens
  Payload ID: 10468
  Gene Symbol: MAP3K12
  Gene Name: mitogen-activated protein kinase kinase kinase 12
  ENST ID: ENST00000552365
  CDS Start-End: 519-1700
gaggtctaggtgttactattgtgtgcctgaggttgaccccgaggtaaaggtgtaaatgtgagacccttctgatacctgtgtgtgcctgtgagtctcgggtgaaaaaaatgtgctgcagcaatgaattagtcatcttacagggagaagggaactcatctgttaccattactcttgaatttgagacatattttaccagtgtgtacccacgtggggctgttacctgagaatgatactcaggtacgatacctgtctacctattacttgccttactaacatgcctgagaggaagcccaagtgtatcagatttcctaagatggctcaaggtgcaatttggagggccatgggaaacggagccacaagtgttacctccagcggggctactgtgaacccagcaccccagtctgtgcctctgggataagtgtcctgagcaggcagtcctggggctttaacagcccagcccctccttccttcattcccacagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccatgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggtgtgctgtgggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatga

SEQ ID NO: 154974 - DNA, 2944 bp, Homo sapiens
  Payload ID: 10468
  Gene Symbol: MAP3K12
  Gene Name: mitogen-activated protein kinase kinase kinase 12
  Uniprot ID: Q12852
  ENST ID: ENST00000547035
  CDS Start-End: 206-2884
ccccagctgctggccctggataccagaagggcctctggggaagcctggtgaactggagggaggctcggctggctgcaagtgtctctgagcatgtcaccctttctatgcctaaaccacctagtcgtcaaacaaccagatgacggctgaaaaattcctttaaaaagccagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacata

SEQ ID NO: 154975 - DNA, 2807 bp, Homo sapiens
  Payload ID: 10468
  Gene Symbol: MAP3K12
  Gene Name: mitogen-activated protein kinase kinase kinase 12
  Uniprot ID: Q12852
  ENST ID: ENST00000547488
  CDS Start-End: 68-2746
cttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatat

SEQ ID NO: 154976 - DNA, 150 bp, Homo sapiens
  Payload ID: 10468
  Gene Symbol: MAP3K12
  Gene Name: mitogen-activated protein kinase kinase kinase 12
  ENST ID: ENST00000548565
  CDS Start-End: 74-150
ggaggaggatggggcctagagccgagtgaattccaaggcccagtgttcaccatcataccaggggccagaggcgatggcttgcctccatgagacccgaacaccctctccttcctttgggggctttgtgtctaccctaagtgaggcatccat

SEQ ID NO: 154977 - DNA, 9876 bp, Homo sapiens
  Payload ID: 10469
  Gene Symbol: MAP3K13
  Gene Name: mitogen-activated protein kinase kinase kinase 13
  Uniprot ID: O43283
  ENST ID: ENST00000265026
  CDS Start-End: 335-3235
ccctcttttttttttcatgacacacaccacagcgaagtctgtgcggaatcctaaaccagcccaatttacatccattcatgaatctgtgacgtcagcaagcctttgggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgcaaaaaaaaaaagagataaaagaaagaacagaaaaaaagaaataagtggaatttaagagcaacatccttgggaatttgtggggccgggaggtattattgctgcttgaacaggggaccaggtcttttggccataagtgactaaagaagagccagagcaagacattgaacattttagaacacaaagaacagcaaaagaaaagcaattccaggcaacttgtgaacagaccatattcacttcaaccagcttgtccaggtggcttacggaaatgacctagaaaagtctggtgaccagatacttgcacccaatgtcttcaagggcatgtgcttcctctaggagggaaaaacagacaaacaaacaaacaaacaaacctgtgtatgtggaagctggtttcatttttaaatgtttaagcagcagttggtagtgaggtttacagatagtgtcaaatcttgtttttggcaaatacgtccctttttagtgctgtcactgtcattaccttggcaaatgtgctaccttgacccaacgtgttgatctttcatactcaagtgccatttccttgtagctcatttcctttctgcctgctgaccacttcctgtaggaacaaaggttggggggcagtactgaggaggagaaaagggtgagagaggaagaacatctacagtggtgttaggaaaacgaacgtggaatttataaaactccattctcaggatcactcagttcagctacgaggagaagatggaaccacccctctctggagccaggttgcttgtctacttgagtcatattgattcaagcaggagaacagactttgaaggcagctaggatgtatgtgtgtctatacaatgtctgagcccaaaccatccctttgtttttattcaataactcattctatcttagaagttcttttttttttttttttttttgacagagttttgctctttttgcccaggctagagtgcaatggcacaatctcagttcactgcaacctccatctcccaggttcaagcgattctcctgcctcagcctcccgagtagctgggattacaggcgcccgcaaccacgcctggctaattttgtatttttagtagacacggggtttcaccatgttggccaggcttgtctcaaactcctgacctcaggtgatccgcctgcctcggcctcccaaagtgctgggattacaggcatcagccactgtgcccggcctatcttagaagtcttaatgactggctaccactgtcagaataaaagcaaaaacaagcagcttgcaaaaggcaactcctctcccagcacaatagcatttttgttcaatgctacttgtaaaatatcttttacttcactccaaatcaatgcagttttaaataactggatttgaacatttgtggaaagaacaagggatgctgagcagggataggaaggatttttacattgccaaaagcatgaggtcctgcctgtctccagggtcatgggctctgaaaagcattccaaggtacttcatggtgccttggccttaaggaaaaatttttttagaattttatgtacaaataggtgttgacctagtacctgtccctgtctccaagacagattaccgtcaaacaacctctctagattcactggactctttgacactgcatcatgttggacgttaggaaatacttgcacagacagctgttaaaccatttccaatgcacatgaaaatgttgccgctcctctgggttttactgattgcatcagccaaaaaggaaaggcaggagggaatttagagttccttttgcttgtttgatccatttgtttacactttatgttgatacattgatttaaaatgtagtgtctgtgatttatagctcttaggatgaaggaaaatgtttaatttatacaaagagcagtattgtttgcattaatttattccattttgtaaaaattctgtagctggactacatgaaagatcttaagttatggcattattatcattgttattttattttataatattatcattctcattttctgtcgatcagaaggtgtgatttatgatgtggcacaatggttgtgtttattgctaaccaggaattattatggattttatgattttaatgaaggaatgaaaatggaattcccatttgggagctccctggtattgatcttagctgtgttccctaattttctgtgtacaacaatcatctgaggacgcatgttctgccctgaagcccaatggatacattgtgattttgacttgatcatgaaagctcctgggtgggccgatgacccccaggatgtcaaatagtggatggacatatagttaaaaagctgtaaactttctaaagtttcttaggaaataaattcatgggactatattagaaataaaaagagaatgatttaatgtcctgagaggaacagacctagagggtttccgcacagggctcatggattcgtttcaagaattgacaacatagtttgcaatctccttcctgccagacccctttgttctcccacctttattctcctagtggagagtagcagggagactaaaaaaagaaatggtatacagtagtcccctcttacccatggcttcattttcatggtttcagttacgctcaacagcagtccaaaaatatttgatggaacattccagaaataaacaattcataaattttaattgcacagcattctgaggagcatgatgagatcttgccccttgctgccctggaggtgatcctccctctgtccagcatattcatgctgctcatccattagtcacttagtagcagtctcggtgatcagatcgactgtctcggttatcagatgactgtatcgcagtgcttgtgttcaagtacccctatttaattaataatagccccaaagggcaagagtgctgtgcctaatttacaaattaaattttatcatagatatgtaagtatagaaaaaaaaacatagtatatatagggtttggtactatcagagtttttaggcatccactgggggtcttggaatgtatcccccagaaataagggaggactaccgtatatacatgtagggcatgacataaaatgcctaactgtgatgtcatcctagaacaagactaaagaactttaagaaggaggcctggtcacttagaggaccaacgactggaaaaaaattcttgaaaggctatattttccatcctcttgacttcagatctcactgtactgtaaatctctctggttcattattccttggaacagagatgctacaactctatgtcttctttctatccaacataaaacactggcagttttgtccaattcttgcccacctttagtggcaacagagaaacatgagggtcagcttttatcttacatctttcagtgatggtcttcctagaaaacctacccctgatacctcgtaattttgatcagttttttttgaattctcatcttgattatctgttatgctattgtcatcatacaccttatgtggattaactgttatgagtatgttagggtagtacgtagtggctgaatctcagtcattcattgtatagtcgagagttgaataaagtccatattgaacacatttttttaagtagaattgactagaggtttcagaggagaataaggtccttagtggaggttaaaaagggaaataccttctctagcccagcctggtccttcgctgcctgccttgtgataaccgggaaaatcttgaattgatgtatgtttctttgagaacgactccacagtcatctgaagagtgttgaatcaagagctcagggaagttatgagctaattcttcagtcctgacaagtgtgttacaacagtgcttccaggaacctcacaagactgtgatttcaagctgcttcattgatggaaagtttcaccatcttgggatgaatgtccatgttccgttagcgtctgtttttaactgactgcaagatgatgagttttaatttgggttgcagatgagcatttggttctgattttcatctatttcaagatcatatcctctggataacagttccttttaaaattgctttgcagaggggctgagaagcctgcatctactttgaaattataatggaccttaccaccacttaagtttagacctgtttgcaagatggtggggagctcctactgagaaagatgaagatgctagctctattgtaaactggcgtcttcatctagctacttgaagttgagatactatattttaaaatgttggcatcaaacaaatctatccttctagaagtaaagacattttgagtaggatttagtaagtactggacatctcctgtagagcttcatcatgctaaattattcccctctccttttctaaataatagatgtgcttgggtttgggatttacctggcaccaacccagactttttttgggggggggtgagggcgcaggatctcactctgtcaccaggttggagtacagtggcatgattatggctcactgcagcctcaacctcctgggctcaagtgatcctcccacctcagcctcctgagtagctgggaccacaggtgtgtgccaccatgcacaacaattttttttttttttttgtagagatgggcgtctccctgtgttgcccaggctggtatcgaactctgggctctagcgatcctcctgctttggcctcccaaagtactgggattacaaacgtgagctgccatgcccagcctccagactattttaaatgccctctcccactgtggaacattggcatcctttaagaataaatgcatcctttttgatcaaatgatttactctttttttcttcaatgtcctcatgtctcaatttttttttccttttcttaaaacagtcccacttgaacttcctggaactgaattctccagaacataatatttataatccatagaattcctgccctgctctgcagtagagtgtgctatgttttgttttcccactgagccagaagccgaaatattatactaccacttaccaccatctaccacctccaagaccaagaccaacattatgtattgagcatcgtatctttcctactgagcctagacacagcctcagaacctctcaacatagcacttggagcaacaattgccgcttgattggaattgccatttgagcttgagttagccccaatggcagaacgacaggctcgcactagtgtccacctgtggctgtcaggggcggtaccacagaaaggggaaaggccacttgcctctacccactgcccttttggacaacaattccaattgaaggaacaccaatcactgatggatcccattccaaaatgtctcttcattcacatcatttaattctgttgaatgaatatgttcctccctcaccttttataaacagaaaattaatataagtcccagttacttgcttcttagactctgtgagactcatgtaccaaaacaatgtgacattcttttcgagactttgacttgtacggtcagtatgaatttagtgcctttccaggcagcaaaatgtttcttctttgctgatttcataggacaaatatcctagcatactcacaccaccagtgtcccaccctcacagactggcacattagaatcatattaatctgcttgtttgcatgttacaactgatactgcaaaagcctattcaagtcggactgaactaggctaagcagaggacccttgtggaacctggagcatttctcagggacaggtggctaaagaggggagctctaaaatcactgctctgagaaacaggaggtgggttaaggcttttgttaactgtcatgtggccagggtacgatggcaggacttcacagagcagagccctaagcagatggcaaggccactgtaaggaagctcccggcagcatcccaggtctgctctccagagccacttcacagcactcagggatcgctggctcccggccctaggctgctgtccagtgaccaggtggacagggtcctccagtgactgcaggccaagggaaccccagccagcatgtgcaagctattaggaagatgtcccatcttgcccatatcaccccagtggctcttcaccttcagagtgaccacttcccagactctggaagtgggaagaccctctttgacgctttattacagtaatttgagctcctatcgacttggagcgaatgaatttctcttttgtggttaggtctccaaatgaacctccttacctggctcccctctggtctcctgtactgtcagtccccagctcccagtgttgttttctgatgccggctccctctctgtattgaacggcaatgggaacaagaatgactatcaaagcaaacaaatgcatggaattaaacaaaaagtgtacttcactg

SEQ ID NO: 154978 - DNA, 618 bp, Homo sapiens
  Payload ID: 10469
  Gene Symbol: MAP3K13
  Gene Name: mitogen-activated protein kinase kinase kinase 13
  ENST ID: ENST00000447637
  CDS Start-End: 280-618
gtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagaggttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaact

SEQ ID NO: 154979 - DNA, 1460 bp, Homo sapiens
  Payload ID: 10469
  Gene Symbol: MAP3K13
  Gene Name: mitogen-activated protein kinase kinase kinase 13
  Uniprot ID: O43283
  ENST ID: ENST00000433092
  CDS Start-End: 154-540
agtttagtctgtgaggaaactggcggctgctggtagttccatgctgtctgttcagacttcagcttggtgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggtaagttgggaaacttcctaccaggtgctactaaacagatagagaactctcaatgaaacagagtaactcttagaagggcccattgtgtttgttataatagttatataactccattcattgtgacacaataaatatgata

SEQ ID NO: 154980 - DNA, 388 bp, Homo sapiens
  Payload ID: 10469
  Gene Symbol: MAP3K13
  Gene Name: mitogen-activated protein kinase kinase kinase 13
  ENST ID: ENST00000438798
  CDS Start-End: 214-336
gttcaatgtgatgtccactaaattttggacatctaaatgtctgtgtagtataacttttattcataatgagttggtatctcagtggtaccttaggtctgtacattgacattcttgaggtttttagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaacc

SEQ ID NO: 154981 - DNA, 1681 bp, Homo sapiens
  Payload ID: 10469
  Gene Symbol: MAP3K13
  Gene Name: mitogen-activated protein kinase kinase kinase 13
  ENST ID: ENST00000448876
  CDS Start-End: 177-299
acgggaggcggtacctggttgtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccaaaaaaaaaaaaaaaaaaaatgtgttctgtggccataagttttcattgatagagaagcataaatttggtgaatttagaattaggtcttttatcatatcctataaaaagttgagttaacaggctgggcacggtggctcatgcctgtaatcccagcactttgggaggccaaggcagctggatgccccaaggtcaggcatttgagaccagcctggccaacatggcgaaaccccatctctactaaaaatacaaaaattagccaggcatggtggcaggcgcctgtaatcccagctactcgagagactgaggcaggagaatcacttgaaaccaggaggcgggggctgcagtgagccaagatcacgccactgcattccagcctgggtgacagagcgagactccgtctaaaaaaaaaaaaaaagttgaattaacaataaggaaatgaggatgaagcggtaaaaatgttttgggttacattatactctcagaagctatgtggtttagagaaaagggcccccaaccacaaaagttagtggttcttattctgtctgcttcgtactaggtatatggtaactgagaaagtcacttaacctctctgaaccttaacttcgtcatctataaagtgaatctaacattttccccccggcctacctcacagggttgttgtgaggatcaaatgaaataatgtacatgaaaagacatatataaaatgtataatacagacaaagggtcctgttacacagttggaagtcattccctcagattttgggcctaggaaggtaggtgatttaaactcactgaaagcatgtaccatgtccaggttggatacatggcaacaaggctatgttaaattttttttctctgagttgagtccctaaaatactatcatgggctaattctaagaaggagcacgaatatatattcccctaaaattatagcttagcattgtcaatgctttagagcagttatgggagttatagattataacatattagtgatttgtgaaacttttttactaaaatgtgaccctcatttttctttacatgaaagaacatagaatatttcacaatgcatcccacgtggtaagaataaaaaattgttttagttatatgtacaaatgtgtgtgtgtgaacgtgtgtgtacttggtcattaaataaaatgtacttttttttttcctgtga

SEQ ID NO: 154982 - DNA, 3156 bp, Homo sapiens
  Payload ID: 10469
  Gene Symbol: MAP3K13
  Gene Name: mitogen-activated protein kinase kinase kinase 13
  Uniprot ID: O43283
  ENST ID: ENST00000424227
  CDS Start-End: 256-3156
tgggtggggcggagcgtctgggatgcgctgggagcctaggatccccgacagaacactgaaatctatggactctaaaatggacttcatttaaagaaacccacggaccattaatggacaaaaacatgagtcaatatgtattgtggcattcaaatcctagcactctgggagaggttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaa

SEQ ID NO: 154983 - DNA, 2882 bp, Homo sapiens
  Payload ID: 10469
  Gene Symbol: MAP3K13
  Gene Name: mitogen-activated protein kinase kinase kinase 13
  Uniprot ID: O43283
  ENST ID: ENST00000438053
  CDS Start-End: 213-695
ctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagtgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaa

SEQ ID NO: 154984 - DNA, 573 bp, Homo sapiens
  Payload ID: 10469
  Gene Symbol: MAP3K13
  Gene Name: mitogen-activated protein kinase kinase kinase 13
  ENST ID: ENST00000428617
  CDS Start-End: 161-573
aaagtttagtttagtctgtgaggaaactggcggctgctggtagttccatgctgtctgttcagacttcagcttggtgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgctt

SEQ ID NO: 154985 - DNA, 982 bp, Homo sapiens
  Payload ID: 10469
  Gene Symbol: MAP3K13
  Gene Name: mitogen-activated protein kinase kinase kinase 13
  ENST ID: ENST00000455188
  CDS Start-End: 157-279
gtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagaacatatgggaaagaaatcccctcggaaaccaaagcccagccatcggagattttaagatttttcaggctttccttataatcttccttacatttgtctctttaaacacatttaagtcgacctttgagaagttgctgataagcagttatcaaacaagagttagagtaacaaaccctcccacctcgctgtgttggttggtagcttccaaggccactgtaaatgtgtatcagtgtgaacctgatccagaaacagccaggaagggagcaaagtttagtttagtctgtgaggaaactggcggctgctggtagttccatgctgtctgttcagacttcagcttggtgtaagtagttttttttaaaaaaaactattatgacattttcatataaaaaggattgtaagaataatttccatcaaagattaaatcaagtttctacctggctctaaatcttagggattagaactactgaaaagaaagtttcagcactcagcagtagttttatttttttttaatggaaaagaaagccgtgaggtgtatcagcaagtgtgctgctaaaacaggtcccgtgtgcacgaaatgatttctaatgtcttatgttgagtgcaagtgtttacagttagaaaataaaagtgagtatgtacct

SEQ ID NO: 154986 - DNA, 911 bp, Homo sapiens
  Payload ID: 10469
  Gene Symbol: MAP3K13
  Gene Name: mitogen-activated protein kinase kinase kinase 13
  ENST ID: ENST00000439882
  CDS Start-End: 86-670
gttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaaggggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatg

SEQ ID NO: 154987 - DNA, 3025 bp, Homo sapiens
  Payload ID: 10469
  Gene Symbol: MAP3K13
  Gene Name: mitogen-activated protein kinase kinase kinase 13
  Uniprot ID: O43283
  ENST ID: ENST00000443863
  CDS Start-End: 202-2670
agtttagtctgtgaggaaactggcggctgctggtagttccatgctgtctgttcagacttcagcttggtggattagaactactgaaaagaaagtttcagcactcagcagtagttttatttttttttaatggaaaagaaagccgtgaggtgtatcagcaagtgtgctgctaaaacaggtcccgtgtgcacgaaatgatttctaatgtcttatgttgagtgcaagtgtttacagttagaaaataaaaatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgc

SEQ ID NO: 154988 - DNA, 2737 bp, Homo sapiens
  Payload ID: 10469
  Gene Symbol: MAP3K13
  Gene Name: mitogen-activated protein kinase kinase kinase 13
  Uniprot ID: O43283
  ENST ID: ENST00000446828
  CDS Start-End: 165-2444
acctggttgtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagaggggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacat

SEQ ID NO: 154989 - DNA, 526 bp, Homo sapiens
  Payload ID: 10469
  Gene Symbol: MAP3K13
  Gene Name: mitogen-activated protein kinase kinase kinase 13
  ENST ID: ENST00000454237
  CDS Start-End: 184-306
aggtaacctgcgggcggatctgaacggggggcgagggtggcagctggagttgatggcctagatcgctcggggccctaagcgcgggtggacacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccaaaaaaaaaaaaaa

SEQ ID NO: 154990 - DNA, 740 bp, Homo sapiens
  Payload ID: 10469
  Gene Symbol: MAP3K13
  Gene Name: mitogen-activated protein kinase kinase kinase 13
  ENST ID: ENST00000420577
  CDS Start-End: 1-740
gtggccatcaagaaagtgagagaacagaatgagacggatatcaagcatttgaggaagttgaagcaccctaacatcatcgcattcaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaa

SEQ ID NO: 154991 - DNA, 4460 bp, Homo sapiens
  Payload ID: 10470
  Gene Symbol: MAP3K14
  Gene Name: mitogen-activated protein kinase kinase kinase 14
  Uniprot ID: Q99558
  ENST ID: ENST00000344686
  CDS Start-End: 102-2945
agcggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtttccaggc

SEQ ID NO: 154992 - DNA, 1049 bp, Homo sapiens
  Payload ID: 10470
  Gene Symbol: MAP3K14
  Gene Name: mitogen-activated protein kinase kinase kinase 14
  ENST ID: ENST00000617331
  CDS Start-End: 79-552
agatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaaaccagcctgggcaacatagcgagatcgcatgtctacaaaagagtaaaaaatagaaataaaaaagaaatttcaaaagtctaaaaagatatctgtcaaagggcagttacctctgagaataggactggggaatggagacttttgctttttttggtatcatttgcattcttttataatgagcctatatttgtttgcaattaaaagtaagatcagggccgagcacggtggctcacacctgtaatcccagcactttgggaggctgaggcaggtggatcacaaggttaggagttcaagaccagcctctggccaagatggtgaaaccccatctctactaaaaatacaaatattagccgggtgtggtggcaggtgcctgtaatcccagctactcaggaggctgaggcagagaattgcttgaacctgggaggcggaggttgcagtgagccaagatcacgccacagcactccagcctgggtgacagagcaagactcagtctcaaaaaaaaaaaaaaaaaaaaaagaa

SEQ ID NO: 154993 - DNA, 4583 bp, Homo sapiens
  Payload ID: 10470
  Gene Symbol: MAP3K14
  Gene Name: mitogen-activated protein kinase kinase kinase 14
  Uniprot ID: Q99558
  ENST ID: ENST00000376926
  CDS Start-End: 232-3075
accgggggactgtgccgtgtggaacgtgtagctgttgagaggtggactctgttaccattgaggatgtttggaggatgagtatgtgtggcagaggcacacataaacaggcagagaccctttgcccctgcctttctcccccaacccaaggctgacctgtgttctcccaggtctgggattctaagtgacctgctctgtgtttggtctctctcaggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 154994 - DNA, 4012 bp, Homo sapiens
  Payload ID: 10471
  Gene Symbol: MAP3K15
  Gene Name: mitogen-activated protein kinase kinase kinase 15
  Uniprot ID: Q6ZN16
  ENST ID: ENST00000338883
  CDS Start-End: 1-3942
atggagagcggcggtgggaatgctccggccggggccctcggggcggcgagcgagtcccctcagtgcccgccgccgccgggggtggagggcgcggccgggccggcggagcccgacggggcggcggagggcgcggcaggcggcagcggcgagggcgagagtgggggcgggccgcggcgggctctgcgggcagtatacgtgcgcagtgagagctcccagggcggcgcggccggcggcccggaggctggggcgcggcagtgcctgctgcgggcctgcgaggccgagggcgctcacctcacctccgtgcccttcggggagctggacttcggggagacggccgtgctcgacgccttctacgacgcagatgttgctgtggtagacatgagcgatgtctccagacagccttccctcttctaccatcttggagtccgagaaagctttgacatggccaataatgtgatcttgtaccatgacaccgatgccgacactgctctctctttgaaggacatggtaactcaaaaaaacacagcatccagtggaaattattatttcatcccatacatcgtgacaccgtgcgctgattatttttgctgcgagagtgatgcccagagacgagcctccgagtacatgcagcccaactgggacaacatcctgggcccgctgtgcatgcctttggtggacaggttcattagcctccttaaggacatccacgtgacctcatgtgtttattacaaagaaaccttgttaaatgacatccggaaagccagagagaaataccaaggtgaggaactggcgaaggagctagctcggatcaagctccgcatggataatactgaggttctgacctcagacatcatcattaacttactcctgtcctaccgtgatatccaggactatgatgcgatggtgaagctggtggaaacactggagatgctgcctacgtgtgatttggccgatcagcataacattaaattccactatgcgtttgcactgaataggagaaacagcacaggtgaccgtgagaaggctctgcagatcatgctccaggttctgcagagctgtgatcacccgggccccgacatgttctgcctgtgtgggaggatctacaaggacatcttcttggattcagactgcaaagatgacaccagccgcgacagcgccattgagtggtatcgcaaagggtttgaactccagtcatccctctattcgggaattaatcttgcagttttgctgattgttgctggacaacaatttgaaacttccttggaactaaggaaaataggtgtccggctgaacagtttgttgggaagaaaagggagcttggagaaaatgaacaattactgggatgtgggtcagttcttcagcgtcagcatgctggcccatgatgtcgggaaagccgtccaggcagcagagaggttgttcaaactgaaacctccagtctggtacctgcgatcattagttcagaacttgttactaattcggcgcttcaagaaaaccattattgaacactcgcccaggcaagagcggctgaacttctggttagatataatttttgaggcaacaaatgaagtcactaatggactcagatttccagttctggtcatagagccaaccaaagtgtaccagccttcttatgtttccataaacaatgaagccgaggagagaacagtttctttatggcatgtctcacccacagaaatgaaacagatgcacgaatggaattttacagcctcttccataaagggaataagcctatcaaagtttgatgaaaggtgttgttttctttatgtccatgataattctgatgactttcaaatctacttttccaccgaagagcagtgcagtagatttttctctttggtcaaagagatgataaccaatacagcaggcagtacggtggagctggagggagagaccgatggagacaccttggagtatgagtatgaccatgatgcaaatggtgagagagttgtcttggggaaaggcacgtatgggattgtgtatgctggccgagatctgagcaatcaagtgcgaatagccatcaaagaaatcccggagagagatagcaggtattctcagcctctgcacgaggagatagccctgcacaagtaccttaagcaccgcaatatcgttcagtacctgggctctgtttcagagaacggctacattaagatatttatggagcaggtgcctggaggaagcctttctgctcttctgcgatccaaatgggggccgatgaaggaaccgacaatcaagttttacaccaaacagatcctggagggccttaagtatcttcatgaaaaccagatcgtgcacagagacataaagggcgataatgttctggtgaacacctacagcggagtggtgaaaatctccgattttggaacctcgaaacgtcttgcgggtgtgaacccctgcacagagacttttactggcaccctgcagtacatggcacctgagataattgaccaagggcctcgcggatatggtgccccagccgatatctggtccctgggctgcaccatcattgagatggccaccagcaagcctccgttccatgagcttggtgagccgcaggcagccatgttcaaagtgggcatgtttaagatccaccctgagattccagaagccctttcagctgaagcccgagccttcattttatcctgtttcgagcctgacccccacaaacgtgccaccactgctgagctactgagagagggtttcttaaggcaggtgaacaagggcaagaagaaccgaattgccttcaagccctcagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaaataaaattttgaggaaccacttaattaggccccactggatgttcgcgatggacaacatcatccgccgagcggtgcaggccgcggtcaccattctcatcccagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacagacttttggaacacctagttgaaaaagagagagagtaccagaatcttctgcggcaaactctagaacagaaaactcaagaattgtatcaccttcagttaaaattaaaatcgaattgtattacagagaacccagcaggcccctacgggcagagaacagataaagagcttatagactggttgcggctgcaaggagctgatgcaaagacaattgaaaagattgttgaagagggttatacactttcggatattcttaatgagatcactaaggaagatctaagataccttcgactacggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgta

SEQ ID NO: 154995 - DNA, 3961 bp, Homo sapiens
  Payload ID: 10471
  Gene Symbol: MAP3K15
  Gene Name: mitogen-activated protein kinase kinase kinase 15
  ENST ID: ENST00000359173
  CDS Start-End: 1-851
atgacatccggaaagccagagagaaataccaaggtgaggaactggcgaaggagctagctcggatcaagctccgcatggataatactgaggttctgacctcagacatcatcattaacttactcctgtcctaccgtgatatccaggactatgatgcgatggtgaagctggtggaaacactggagatgctgcctacgtgtgatttggccgatcagcataacattaaattccactatgcgtttgcactgaataggagaaacagcacaggtgaccgtgagaaggctctgcagatcatgctccaggttctgcagagctgtgatcacccgggccccgacatgttctgcctgtgtgggaggatctacaaggacatcttcttggattcagactgcaaagatgacaccagccgcgacagcgccattgagtggtatcgcaaagggtttgaactccagtcatccctctattcgggaattaatcttgcagttttgctgattgttgctggacaacaatttgaaacttccttggaactaaggaaaataggtgtccggctgaacagtttgttgggaagaaaagggagcttggagaaaatgaacaattactgggatgtgggtcagttcttcagcgtcagcatgctggcccatgatgtcgggaaagccgtccaggcagcagagaggttgttcaaactgaaacctccagtctggtacctgcgatcattagttcagaacttgttactaattcggcgcttcaagaaaaccattattgaacactcgcccaggcaagagcggctgaacttctggttagatataatttttgaggcaacaaatgaagtcactaatggactcagatttccattatgaaatatttcaaacctactgaaaggtacaaaaaaataatggagcagacaaccgcgtaatctctaaccaggttctggtcatagagccaaccaaagtgtaccagccttcttatgtttccataaacaatgaagccgaggagagaacagtttctttatggcatgtctcacccacagaaatgaaacagatgcacgaatggaattttacagcctcttccataaagggaataagcctatcaaagtttgatgaaaggtgttgttttctttatgtccatgataattctgatgactttcaaatctacttttccaccgaagagcagtgcagtagatttttctctttggtcaaagagatgataaccaatacagcaggcagtacggtggagctggagggagagaccgatggagacaccttggagtatgagtatgaccatgatgcaaatggtgagagagttgtcttggggaaaggcacgtatgggattgtgtatgctggccgagatctgagcaatcaagtgcgaatagccatcaaagaaatcccggagagagatagcaggtattctcagcctctgcacgaggagatagccctgcacaagtaccttaagcaccgcaatatcgttcagtacctgggctctgtttcagagaacggctacattaagatatttatggagcaggtgcctggaggaagcctttctgctcttctgcgatccaaatgggggccgatgaaggaaccgacaatcaagttttacaccaaacagatcctggagggccttaagtatcttcatgaaaaccagatcgtgcacagagacataaagggcgataatgttctggtgaacacctacagcggagtggtgaaaatctccgattttggaacctcgaaacgtcttgcgggtgtgaacccctgcacagagacttttactggcaccctgcagtacatggcacctgagataattgaccaagggcctcgcggatatggtgccccagccgatatctggtccctgggctgcaccatcattgagatggccaccagcaagcctccgttccatgagcttggtgagccgcaggcagccatgttcaaagtgggcatgtttaagatccaccctgagattccagaagccctttcagctgaagcccgagccttcattttatcctgtttcgagcctgacccccacaaacgtgccaccactgctgagctactgagagagggtttcttaaggcaggtgaacaagggcaagaagaaccgaattgccttcaagccctcagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaaataaaattttgaggaaccacttaattaggccccactggatgttcgcgatggacaacatcatccgccgagcggtgcaggccgcggtcaccattctcatcccagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacagacttttggaacacctagttgaaaaagagagagagtaccagaatcttctgcggcaaactctagaacagaaaactcaagaattgtatcaccttcagttaaaattaaaatcgaattgtattacagagaacccagcaggcccctacgggcagagaacagataaagagcttatagactggttgcggctgcaaggagctgatgcaaagacaattgaaaagattgttgaagagggttatacactttcggatattcttaatgagatcactaaggaagatctaagataccttcgactacggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgtatacacgaattccgctgtgtttacatatttaaaaatgccattgttcaattaatagtttaagaacttgttttaaatactgtcctgagtttcttttgaaacctgttatttataaacatagaactgtgtgtattgtgaaaacagtgagccttggttttgacctcccggaatattaggaaattcacttgtagtcccagctatgcaggaggctgaggtgggaggattgcttgagcccaggaggtgtggaggctgcagtgagccatgatcacaccactgcactccagcctgggcaacagagcccgaccctgtctcaaaaaaagtacacccttcagcacttgctggaatggtgaaacaaacaaggggtatttaacaaacatggaagctgggacactgcctcagaactggtatggtacttcaatttgagaaacacaaaactgatacgaatgtgccttgtagttaatgtttgatatgaacagaaaatagcttcatatttatactgaatgtgtaagtagagaaaactaagttatgtggcctttgaaatgattacaaaattggaatgattacaaaagtcttattttaaaatggaactgtcctcttgcctgataataaatattgtatcttgtag

SEQ ID NO: 154996 - DNA, 3719 bp, Homo sapiens
  Payload ID: 10472
  Gene Symbol: MAP3K19
  Gene Name: mitogen-activated protein kinase kinase kinase 19
  Uniprot ID: Q56UN5
  ENST ID: ENST00000358371
  CDS Start-End: 32-3679
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaagagttttcgacctctcatatgaagtacagtggccgaagcatcaagttccttctgccaccactgtcactcttgcccacgcgatctggtgtccttactatcccccaaaatcacaagtttccaaaagaaaaagaaagaaacattccaagtctcacatcttttgtgcctaagctctcagtgtctgttcgtcaatctgatgagctcagcccatcaaacgagcctccgggagccctagttaagtcgttgatggatccgactctcaggtcttctgatggcttcatttggtcaagaaacatgtgctcttttcctaagactaaccatcacaggcaatgcctggagaaggaggaaaactggaaatccaaggaaatagaagaatgtaacaaaattgaaatcactcactttgaaaaagggcagtctttggtgtcttttgagaatttgaaggaaggcaatattcctgcagttagggaagaggatattgactgccatggtagtaaaacgcgaaaacctgaagaagagaactctcaatatctttcatcaagaaagaatgagagttcagtagccaaaaactatgaacaagatccagaaatagtatgtaccattccaagcaagttccaagaaacccagcattcagaaataactccaagccaggatgaagagatgagaaataataaagctgcttcaaaaagagtttcattacataaaaatgaagcaatggaaccaaacaatattttagaagagtgtactgtacttaaaagcttatccagtgtagtctttgatgaccccattgataaactcccagaaggttgtagcagcatggagacaaacataaaaatatcaatagcagaaagagccaaaccagaaatgagtaggatggtgcctcttatccacatcaccttccctgtggatggaagccccaaggaaccagtgatagccaaaccaagcctccaaacaagaaagggaaccattcataacaaccatagtgtcaacatacctgtacaccaagaaaatgacaagcataagatgaattcccataggagtaagttggattcaaagaccaagacaagtaagaagacacctcagaattttgtgatttctactgaaggtcccattaagcctaccatgcataaaaccagcataaaaacacaaattttcccggctttgggacttgtggaccccaggccttggcaattgcccaggtttcaaaagaaaatgccacagatagcaaagaagcaatcaactcaccggactcagaaacctaaaaagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgc

SEQ ID NO: 154997 - DNA, 1604 bp, Homo sapiens
  Payload ID: 10472
  Gene Symbol: MAP3K19
  Gene Name: mitogen-activated protein kinase kinase kinase 19
  Uniprot ID: Q56UN5
  ENST ID: ENST00000375844
  CDS Start-End: 32-1564
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgc

SEQ ID NO: 154998 - DNA, 4377 bp, Homo sapiens
  Payload ID: 10472
  Gene Symbol: MAP3K19
  Gene Name: mitogen-activated protein kinase kinase kinase 19
  Uniprot ID: Q56UN5
  ENST ID: ENST00000375845
  CDS Start-End: 32-4018
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagttccttctgccaccactgtcactcttgcccacgcgatctggtgtccttactatcccccaaaatcacaagtttccaaaagaaaaagaaagaaacattccaagtctcacatcttttgtgcctaagctctcagtgtctgttcgtcaatctgatgagctcagcccatcaaacgagcctccgggagccctagttaagtcgttgatggatccgactctcaggtcttctgatggcttcatttggtcaagaaacatgtgctcttttcctaagactaaccatcacaggcaatgcctggagaaggaggaaaactggaaatccaaggaaatagaagaatgtaacaaaattgaaatcactcactttgaaaaagggcagtctttggtgtcttttgagaatttgaaggaaggcaatattcctgcagttagggaagaggatattgactgccatggtagtaaaacgcgaaaacctgaagaagagaactctcaatatctttcatcaagaaagaatgagagttcagtagccaaaaactatgaacaagatccagaaatagtatgtaccattccaagcaagttccaagaaacccagcattcagaaataactccaagccaggatgaagagatgagaaataataaagctgcttcaaaaagagtttcattacataaaaatgaagcaatggaaccaaacaatattttagaagagtgtactgtacttaaaagcttatccagtgtagtctttgatgaccccattgataaactcccagaaggttgtagcagcatggagacaaacataaaaatatcaatagcagaaagagccaaaccagaaatgagtaggatggtgcctcttatccacatcaccttccctgtggatggaagccccaaggaaccagtgatagccaaaccaagcctccaaacaagaaagggaaccattcataacaaccatagtgtcaacatacctgtacaccaagaaaatgacaagcataagatgaattcccataggagtaagttggattcaaagaccaagacaagtaagaagacacctcagaattttgtgatttctactgaaggtcccattaagcctaccatgcataaaaccagcataaaaacacaaattttcccggctttgggacttgtggaccccaggccttggcaattgcccaggtttcaaaagaaaatgccacagatagcaaagaagcaatcaactcaccggactcagaaacctaaaaagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgctcccttgcttaattgtggggaatgatggctaagggatctttgtttccccactgaaaattcagtctaacccagtttaagcagatcctatggagtcattaactgaaagttgcagttacatattagcctcctcaagtgtcagacattattactcatagtatcagaaaacatgttcttaataacaacaaaaaactatttcagtgtttacagttttgattgtccaggaactacattctctattgttttatatgacatttctttttatttttggcctgtcctgtcaattttaatgttgttagtttaaaataaattgtaaaaacaa

SEQ ID NO: 154999 - DNA, 4350 bp, Homo sapiens
  Payload ID: 10472
  Gene Symbol: MAP3K19
  Gene Name: mitogen-activated protein kinase kinase kinase 19
  ENST ID: ENST00000392915
  CDS Start-End: 121-3579
agaactgcgagatgtgatgttgacagcggagacacagagacaaccgctgagaaacttgagtcaaagatgactaaattttaaggcctggaaagtgcaggagatggaaatacaaccaacaaaatgggagcacattggaactttcaagtagcaagtttctgtaggactgggcttgtgggaaaggaccggttgaaagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagttccttctgccaccactgtcactcttgcccacgcgatctggtgtccttactatcccccaaaatcacaagtttccaaaagaaaaagaaagaaacattccaagtctcacatcttttgtgcctaagctctcagtgtctgttcgtcaatctgatgagctcagcccatcaaacgagcctccgggagccctagttaagtcgttgatggatccgactctcaggtcttctgatggcttcatttggtcaagaaacatgtgctcttttcctaagactaaccatcacaggcaatgcctggagaaggaggaaaactggaaatccaaggaaatagaagaatgtaacaaaattgaaatcactcactttgaaaaagggcagtctttggtgtcttttgagaatttgaaggaaggcaatattcctgcagttagggaagaggatattgactgccatggtagtaaaacgcgaaaacctgaagaagagaactctcaatatctttcatcaagaaagaatgagagttcagtagccaaaaactatgaacaagatccagaaatagtatgtaccattccaagcaagttccaagaaacccagcattcagaaataactccaagccaggatgaagagatgagaaataataaagctgcttcaaaaagagtttcattacataaaaatgaagcaatggaaccaaacaatattttagaagagtgtactgtacttaaaagcttatccagtgtagtctttgatgaccccattgataaactcccagaaggttgtagcagcatggagacaaacataaaaatatcaatagcagaaagagccaaaccagaaatgagtaggatggtgcctcttatccacatcaccttccctgtggatggaagccccaaggaaccagtgatagccaaaccaagcctccaaacaagaaagggaaccattcataacaaccatagtgtcaacatacctgtacaccaagaaaatgacaagcataagatgaattcccataggagtaagttggattcaaagaccaagacaagtaagaagacacctcagaattttgtgatttctactgaaggtcccattaagcctaccatgcataaaaccagcataaaaacacaaattttcccggctttgggacttgtggaccccaggccttggcaattgcccaggtttcaaaagaaaatgccacagatagcaaagaagcaatcaactcaccggactcagaaacctaaaaagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagttcaagtccaatgggaaagaaatatcttccttcaacagctgaatatgttactggaagtttggagaatcattactagatggcaaaaacaaaagatgttccttccattttgtgaactgcataagagatcttggggggtgggcgatgaagagaggtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccaggtaagaaactgaaagcaagaggaggaagataaatgcccggagattccaagtggcagacatttccctttcaatttatggcccattaaaagctctgttttggttatgaa

SEQ ID NO: 155000 - DNA, 1765 bp, Homo sapiens
  Payload ID: 10472
  Gene Symbol: MAP3K19
  Gene Name: mitogen-activated protein kinase kinase kinase 19
  Uniprot ID: Q56UN5
  ENST ID: ENST00000392917
  CDS Start-End: 32-1414
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaaggtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgctcccttgcttaattgtggggaatgatggctaagggatctttgtttccccactgaaaattcagtctaacccagtttaagcagatcctatggagtcattaactgaaagttgcagttacatattagcctcctcaagtgtcagacattattactcatagtatcagaaaacatgttcttaataacaacaaaaaactatttcagtgtttacagttttgattgtccaggaactacattctctattgttttatatgacatttctttttatttttggcctgtcctgtcaattttaatgttgttagtttaaaataaattgt

SEQ ID NO: 155001 - DNA, 1460 bp, Homo sapiens
  Payload ID: 10472
  Gene Symbol: MAP3K19
  Gene Name: mitogen-activated protein kinase kinase kinase 19
  Uniprot ID: Q56UN5
  ENST ID: ENST00000392918
  CDS Start-End: 32-1420
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagaggcatagtagtgggctcaggatatatgacagggaggagaaatttctcatctcaaatgaaaagaagatattttctgaaaatagtttaaagtctgaagaacctatcctatggaccaaggtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgc

SEQ ID NO: 155002 - DNA, 537 bp, Homo sapiens
  Payload ID: 10472
  Gene Symbol: MAP3K19
  Gene Name: mitogen-activated protein kinase kinase kinase 19
  ENST ID: ENST00000425952
  CDS Start-End: 231-537
agaaaattgcagagggctgagccgaggaggtgcacccgcagatagagaggagcggtggggacatcaggactcaggaagtgagaggaggaggagaatcagaagagagttgcgggaagaaaggagcaggaaacaatgttaaattggaaaagagattacaaagcagatgtgaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagc

SEQ ID NO: 155003 - DNA, 2195 bp, Homo sapiens
  Payload ID: 10472
  Gene Symbol: MAP3K19
  Gene Name: mitogen-activated protein kinase kinase kinase 19
  ENST ID: ENST00000437365
  CDS Start-End: 1-2094
aagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccaggtaagaaactgaaagcaagaggaggaagataaatgcccggagattccaagtggcagacatttccctttcaatttatggcccattaaaagctctgttttggttatg

SEQ ID NO: 155004 - DNA, 541 bp, Homo sapiens
  Payload ID: 10472
  Gene Symbol: MAP3K19
  Gene Name: mitogen-activated protein kinase kinase kinase 19
  ENST ID: ENST00000414343
  CDS Start-End: 477-541
gtaaactaagcagtctatttgcagctaactaaagggtttgtgcatgcaggaccagcttaattaaagacaaaatttaaaaggaaaaattatttgggctgtacaacactgaaaaaaaaatctgaatctatgctgtttttaaatggatccctggttgaagtgtgggttacagctgtcccagaaatcagtgccacaatgaattaggatgatgttggctactgtttggcttggtgtttcttcaactgtgtgccacgtccctcagcaaaacacagcacagaagtggtttcaagaggtgatgtggaactcatctgtgactatattaccgaagtccaatccatcctcggaaaccttgactttcagcacccagagacgtggaatacgcctctcattactgcagcagaggaaaatctaacagagaaagacatgctgagtcattgcttgacatttgtcatgatacaaactcttctccaactgatttgatgacagttaccaaaaatcaaaacatcatcttgcaaagcatcagcagaagtgaggagttcgacca

SEQ ID NO: 155005 - DNA, 2135 bp, Homo sapiens
  Payload ID: 10473
  Gene Symbol: MAP3K2
  Gene Name: mitogen-activated protein kinase kinase kinase 2
  Uniprot ID: Q9Y2U5
  ENST ID: ENST00000344908
  CDS Start-End: 101-1960
ttttattaatatgctgatctgttttatcttctcaggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatttgaacatagaggagaaaaaagaatccttcagttccccagaccagttaaactggaagatctgagatctaaagctaaaattgcctttggacagtctatggatctacattataccaataacgagttggtaattccattaactactcaagatgacttggacaaagctgtggaactgctggatcgtagtattcatatgaagagcctcaagatattacttgtaataaatggaagtacacaggctactaatttagaaccattgccatcactagaagatttggataatacagtatttggagcagagaggaaaaaacggctatctataataggtcctactagtagagatagaagttctcctcccccaggttacattccagatgaattacaccaggttgcccggaatgggtcattcactagtatcaacagtgaaggagagttcattccagagagcatggaccaaatgctggatccattatctttaagcagccctgaaaattctggctcaggaagttgtccatcacttgatagtcctttggatggagagagctatccaaaatcacgaatgcctagggctcagagctacccagataatcatcaggaattttcagactatgataaccctatctttgagaaatttggaaaaggaggaacatatccaagaaggtatcatgtttcatatcatcatcaagagtataatgatggtcgtaaaacttttccaagagctagaaggacccaggggaccagcttacggtctcctgtgagtttcagtcctactgatcattccttaagcactagtagtggaagcagtatctttaccccagagtatgatgatagtcgaataagaagaaggggaagtgacatagacaatcctactttgaccgtaatggacatcagcccacccagccgttcacctcgagctccgaccaactggagattgggcaaactgcttggccaaggagcctttggaagggtctacctctgttatgatgttgatacaggaagagaattggctgttaagcaagttcaatttgaccccgatagtcctgagaccagcaaggaagtaaatgcacttgagtgtgaaattcagttgctgaaaaacttgctacatgagcgaattgttcagtattatggctgtttgagggatccccaggaaaaaacactttccatatttatggaatatatgccagggggttcaattaaggaccaattaaaagcatatggcgctcttactgagaatgtgactaggaaatacacccgtcagattctggagggtgtccattatttgcacagtaatatgattgtccatagagatatcaaaggcgcaaatatcctgcgagattcaacaggcaacgtcaaactaggagattttggggccagcaaacggcttcagaccatctgtctctcagggacaggaatgaagtctgtcacgggcacaccatactggatgagccctgaagtcatcagtggagaaggctatggaagaaaagcagacatctggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagatgggggagaaaaaagacaagagggaaagtatttctcttgattcttggttaaatttgtttaataataataatatcctaaatt

SEQ ID NO: 155006 - DNA, 689 bp, Homo sapiens
  Payload ID: 10473
  Gene Symbol: MAP3K2
  Gene Name: mitogen-activated protein kinase kinase kinase 2
  ENST ID: ENST00000409179
  CDS Start-End: 547-689
gcggcggcgcctgacgagggtgccgcggccgctgggcgcagcgttcgggggttgcacggcccgcggcggcgacgaaaacaacgaccaggacgctcggcgcccctgtccgcagagtcgccactcccgcctcttctccggtctctagcgacgcgggcccgcggcttcctcctttcctgcccagttcccgcgggcctcggggttgcagcggctagaagtgccgaggagcgccaggaggacccggccggctgcgaggattcacgcgcccgccaccccgcccggcccgggcttcatgtgaaagagggacgggcctggccccaaggcccgcgcccgactcctcgcgcgcccctccggtccccgggggccctgcggcagcccccgacctggggccgcggtgacaggccgcgctggggcggaggggcgggctcggcgggggcggcccctccttgggcctgcggctctctacgtccctgcggagcagccggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatt

SEQ ID NO: 155007 - DNA, 10992 bp, Homo sapiens
  Payload ID: 10473
  Gene Symbol: MAP3K2
  Gene Name: mitogen-activated protein kinase kinase kinase 2
  Uniprot ID: Q9Y2U5
  ENST ID: ENST00000409947
  CDS Start-End: 284-2143
tttctaaagtccctcaggaaaaaaattctgaaacttgagccacaaattaagaggcagacggcttttctccttgcaaatgacctgccacacagtccgtcactgcctctgctagctctgctacccttgggccctgtccacagcccacgtgggagaccttttcacgggatctactcggatgtctgggatctggccactaccgcaggctcgagacaacccaggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatttgaacatagaggagaaaaaagaatccttcagttccccagaccagttaaactggaagatctgagatctaaagctaaaattgcctttggacagtctatggatctacattataccaataacgagttggtaattccattaactactcaagatgacttggacaaagctgtggaactgctggatcgtagtattcatatgaagagcctcaagatattacttgtaataaatggaagtacacaggctactaatttagaaccattgccatcactagaagatttggataatacagtatttggagcagagaggaaaaaacggctatctataataggtcctactagtagagatagaagttctcctcccccaggttacattccagatgaattacaccaggttgcccggaatgggtcattcactagtatcaacagtgaaggagagttcattccagagagcatggaccaaatgctggatccattatctttaagcagccctgaaaattctggctcaggaagttgtccatcacttgatagtcctttggatggagagagctatccaaaatcacgaatgcctagggctcagagctacccagataatcatcaggaattttcagactatgataaccctatctttgagaaatttggaaaaggaggaacatatccaagaaggtatcatgtttcatatcatcatcaagagtataatgatggtcgtaaaacttttccaagagctagaaggacccaggggaccagcttacggtctcctgtgagtttcagtcctactgatcattccttaagcactagtagtggaagcagtatctttaccccagagtatgatgatagtcgaataagaagaaggggaagtgacatagacaatcctactttgaccgtaatggacatcagcccacccagccgttcacctcgagctccgaccaactggagattgggcaaactgcttggccaaggagcctttggaagggtctacctctgttatgatgttgatacaggaagagaattggctgttaagcaagttcaatttgaccccgatagtcctgagaccagcaaggaagtaaatgcacttgagtgtgaaattcagttgctgaaaaacttgctacatgagcgaattgttcagtattatggctgtttgagggatccccaggaaaaaacactttccatatttatggaatatatgccagggggttcaattaaggaccaattaaaagcatatggcgctcttactgagaatgtgactaggaaatacacccgtcagattctggagggtgtccattatttgcacagtaatatgattgtccatagagatatcaaaggcgcaaatatcctgcgagattcaacaggcaacgtcaaactaggagattttggggccagcaaacggcttcagaccatctgtctctcagggacaggaatgaagtctgtcacgggcacaccatactggatgagccctgaagtcatcagtggagaaggctatggaagaaaagcagacatctggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagatgggggagaaaaaagacaagagggaaagtatttctcttgattcttggttaaatttgtttaataataataatatcctaaattttttatatttaatctttttttcccttacaagaacttgaagtttttttttttaatttttataatgtactgatgtggttcagagagataaagcactttagtacatagtcactctttttagtacaaacaaatcatttggaatacctaaagattgtagagtcattccctctatcactgacacatcagtgacgatgggaagacatggaaaacaaggagaagaaaatgatgtataatttgtagtttttagtgatagtatttaaaatatatcctcatttgtggggttgagccctaaactttagtttagggtaggtactcaacttaaagaatataggtttcttcttatatctgtattctttagatcctaacctctgtctaccaacctttttgctcagtaggagtcttgatagaagatatgaatctctgagaggtatgtttatttgttaatcctaaccagtataataagcaaatacactataatagatccacgttactggaatctgtaaaccttgagggatagctttctgcttaaaaacacacacacacacacacacacacacacggaaaacctttattttaaagtcaagttgtgagcaaatagaaataaaagacaaaaggacatcactcttatcaaatgtgtgagcagtagaagagaccacatttacagtcaatagaaataatgaaaaaaaattaggtgtttagtgtattttaaacagttttgttttgttttacttgagggggacgtcccaaaattaaaggaatggagaaataatcaaaatcatgtataccatcttctatttccagctcctgattccccataggtaacatcccttaggagcgaagagttcaattagtaatgtttatgtgttatgtcaggagatgaaacccttgttcttaggatcacagaatactaaagcacctcaaaaaaacaggtatcatgtgaaacagtggttgccaaaagtggagcgaggatgatttcactaggcatttggcaattcttagagacatttccggttgtcacaattggagggatactagtaacatgaattgggtagaggccagggatgttgctaaatagattataatacacaaggaaagcagcctcaaagaattacccctcccaaaatgtcagaagtgctgaggctgagaaaccctgatgtaaagatcagtcccagttataaactgaaaacagctatttacaaagcagtaaatgcaagaaagaaaaggaagtcgcaaagagaaagtgatgtaatgcaaattgaggattttacaagatcagatactgctgctttaagtcaagggtgaataatctcaacaaacagcaaatagcaatcactttaccagctgcatattgcacccacataggtaactcttcattttaggaacaaactgaatttgaacactgagccttttgaactcagccatctctatatattctttccttaaaattcatgattttgggcaaaaaaaaaaaaaaaagcatatcaaaacaaaattttaactactaatgggaaggttaaaaagctgccacgtatttctagtacaatgtatccaataagagcaaggacattgttaaatggaacaagacagctgggaaaggccccactatctctaatagaattgtgctactataaaacatgaagatatcagcaatttggccacttgcagtttttttcagcatgttaaagcaagtgctaagtactttattagtactttatttagtactttattttaaaggtctagaaaacaacagtcttcctggaggccccagaatccctttcatgggattcataagggactcaggtattcttattttctgccaaaaggtgtgcttatttagggactcttttacgatactttgtttctgaagttaggtagatcttggtttactgtgccaaggtcctacctagcattccctgtaggaatatttgaaattccactagctagtctaagaagtcaaagcacaaaattaattgtcaacgcttctctcatattcttaaaattgaagcagtttgcagggaagaacaagaatgaggtgtccctgccttggtaaagcaactgccaaattttgttctagaaagaatccccaagtgtgtggatctattataatttctttatcttttatgaatgagggcatcttttctacttgagcaagatcatggtccttgaccagtgggcttttccttcatatctgtcttgtgtagttgtgcttttcctttggctcgtttttggtctgtcagggtaaccagcagtgcacaatatgagacaaatgctctttagagagaaatctggtgagactgtagaacccagagcaaaactgtttttttttcagtctctgttttcttttctaaatgctatagaaaataaaggcacctgaaaagaaactactactttaacactgctgtggaaggcctttgctttataagaaaaatattattagctatgggaaagtaatgttctttatgtaaagacttaaaaatagactaatagtttacagagttattatataaaatacgatgtgaatttatttcaaacaagttgtgaaggtaccaaaaaccacaataaaagttaatatatataaaaactactagaacaaaaaagcttgaaggtgtgggggtggagggtatggaagaccaaaagtaaatttaaaaaagaaatttttgaaaggaaacagctttatcaggggaagttaaatataacactccgtttttttcttctttctaataatgatatggatcaacaaatgcaatttgaactttttaagataactctaaatgtgttttgtttcttaaatgcacaattgattcttctatactgtaatgcttctttgctgacgctggaaaatggtcagactgctgactttgtgcctttaaaatgcattctgctttgacagtggcagactttttggtgctggagaagattcactagcagtcttatatgtgcttttcaggaaatatctttctacttaaggccttgagagattcaaagtggcatgacttaggcttggaccaaatataagatcttttacattgcaaacaaaatgttgtattgaataaaagggttaaaaaaatcataatgactagtggaaattttgatgggttgttaattatttaaaatgtatttgaaagtatacagactgaaaatttcagtatgaatatcttgaaaattttcagcacttttccttgtttacaaaacatctttctaacttaaaaaaatgactattgccttagaaagttttaaaaggcacagttacccttacataacatatataaggaattaaaatattaatgcatttgctgaactgtaaaagaaaattttaaaccttgatttcagagtgaattggattggctttcacttgagagagtctttaccttattcccaaagaaactgcattaaaaagatgaaactatttctttagactaagtctctgctactccagctcatatatatgtcagatctgctctgtagtatttctgacatggagttgttataagatatgtgaaatcacttagaaaataaaatcagatgtgaatagtttagcaggatgaccaagccagatgcagactccttggcctatggcaaagttctgtgccagtgattttatttggagtctgggaactgatagcttgatataaaatcacctggtgtcaattaaatatacaaatctatcttttttaatagaatgaatcttctttgtttgttcaataattgtaacttattatgtcaggtactaaattaacatccttaaggaggtcacaatctaggaggaacatgggcaaacagttacttattttatggcatacgctaactctgaaagttcagcaatgatgttttaaaatgttattttttattaagggaaaagcaattttaggtaatcattggctgttataaacggaaatgtcactgacaacagggattagagtaaaagtatctccaaactagagggatcccctccccaaccaggtcacatagcatctctctcaggaccccctcttactgcaaaacccagcctctactcaacagttctggtgatggggagcatttattccataacagtgtttttttgttcttttttttttttttccccagtgtctcttttaaagaaaacatactttattttggtctaaattgtgaaaatacccaaaacatttgatagaaattgaactctgtcaacagtgttatttatactaagatcaggacagttccttgagatcatactgttttattactaagtttggcctttgttttacaaatgtaatgttcatatttatttgaattttaagattggttaaatgttaatgaaaagcaatccaattgttaatttttagtagtgccttttctctgtatgccttaattttattttatattaataattcaagttacccaccaaaatgaagattttttccaaaatcagtaggcttcacaagttcatttggccttagactgtgtattggtccttaaatgtttcttaatgcctgcctcctcctacccttttctacctcctttttaaaaaaataaataaataaataaataaatgttaggagagaaacattaggatttgtctgtgatagacatgctgcagcttccactagacatgaattcccaacacaagcatagaaagaggtattctcgttctaaagagacatgtaaatgttttctgggttgaatatttgattttcaatcacattggcactgtccaagttcttggcatattatagttcagttatgattttcatggtagagttacaatacttgtttttgccctaaagaagtcattcacatggtttacaaatgttaaggcaatgagataggacagtgagtaggaaatccagggatagcagattctagtccttaattctcagctaacattttgggtaatactcacagaaaagttacttttctgtgaagtgtgtgcatgtgtgcatgtatgtgtgcgtttgcatgcatgtgtgtgtgtgtgtgtgtgtggttagagttggaggcagggatgggaaggaagaaggggaaaggtatgagtgttcaattaggtcagtttctggttttggaagaacaactcaaatgtatgacctactgatgacatacagtgagtgtagtcatccttgggtaggaacaccagtacattttccagaagtagctagtacaaatgattgtataataatattgattgtaaattgccatactcttggttgctaaaggtagattaaaattcaatttgtgtatatgtaaaataatcttatatataattcttaaatagaaagtaattgattttacatagttcttcctgaactttttggaactgaaattctgccaaacattatcaaaataagcttccttagcttaccaagtattcacaaggaaattctcttgtacctctttttggttggctaggggaagcatgctgtgaagcagctattcctacttatagttgtctttggcttggctttgacttctgccatggtttggacaggatgccatggtaggtgtgggaagtatcagggcctcccatcttcccatactcaccttccagagctgttgatggaaatgagctcttgggggagcctagagattcttttttcagtggtcctgtaagcattcaaggttgagcttcagaaagatgagggaggagtcatagctacagtaaagaaaagaatagattttatctgttgcctgtatacagtctcatagaattcttatttttcataattgtgcattttaattgatagtcatatggtatttttgttaataacagcaaaggcattaaatcagtaccattgttccttctgcctgatgacttcttgtttgtaacacaatctgtattatcagaatcactttaaaccaaagcttttatattccctgtacacatagccaaaataattagcactgttacttctgtccacttgtaagctaatagtataaaaattataaagcagatactagtagaatttgtattctggtatatccttcaaggaaaaggacaggtgatcagtgcatttagacatccagaagttacttccactattgaggaactatgtagacatgaatttaagcttgtacatgtgccaatcttgttaatgtcacttgaccactgattcacatagacagacattaacgtctgatgcctcaggttgatggcgaactttcttcctagtgtcttaacatttatgaacttatgtttgacttgaggggcatttcagcaaagctgtgaggaaaagtaggttctggactgatgtctgctttgtgccatagacattttggaacataaggaagtatctgcttctactatatgtacaggacttgtccccaaataatttctgaatcccttaatgcagttgagaatcccttaatgcagttgagaacagtaaagttcatgaccataccgaaaagcacttttaagttcacttctttttaaatatttttttagaatttattttttaaaagcatatgtaactagtgatgattttagcattagctttacttggaggggagaagaaacaaaattacaccttaaactctattagatagactacaaaatggatttgatgtattcttacttttccaaagaattttttccacctggaataagaagagaggactagttgaaacatttgagctggagaggcttatgggcaatatgaagtgggccaaattcttgcaatacaccctattcaattgaaagtacagtgtctaaggataagaatacttctttaaagaccaacaattgttttaatgcaatcttaattagtaaatggtttacattttttctattgttattggttttaaaatttgctaccctgaattctgaaatattataagagttaataccaaaaatacttttaatgtctgacatctcttacatttcacatggttctttttattcattgtaaataaaagtaaacttggataaatttgagaataaactttgaattgttgcaaactatgattatcaatttgtaaatttaccctttgacataataatgtacatttttaaatgtagccattaaattctctatatttaacctattggtttctctctaaatgtttttaatctcagttgaatgctgggcagtttataattatgtacaaagggtttttttcctattaagattgacatttttgcacatttttggaaatgtttaatttgtacactgatttactactctgaccaataattgttgatgagtgtatgagcatcatgaatgcgtgcattgaactactgtctgtgtctttatgttttaacttctttcaagatgtagccatcagttactgcactgctattactgacttaaatggacctttttgcttttacaaactatacttatctatggttctttgttgaagaactcaggagttcgacattaatagaaattagaaaattttataatgtattataaaatccattactaagttgaaagtatgcttttaactgtgtatcaggggatgtatgtttgtgtggagatgtttttttctgtctgtaggcacatgtatatatcccagtaagttcttattttcatttcatttctacatttttatgaacttgttttataagggtactgtttagttgtgataattaaatatatataaaagctttctgagagattatttactatatgaatatattttcagctggctgatcaaaagtatttttaaaattttgtttttagccattcaaaatgtatttgtattttcagaattgaatgcaagtcatacttagagctcaattaaaatactcttgcaagaaaaagcattaaattctctttgagaattccgtgaaatgcaaattaagggaaaaataggttttaagcagtagcaaaaacacaccgctaaaaatggcctttgaattctcagagctatggaaaaatgtgagaaactaaattgtctcgagatgtcaagatttttctatctccagttgctattggcctgtcctactgttgtctttgaatatttcctgtattccaccccaaaagatttcaacttttagtttttctatcactgggcaaggtcagactgggtttataaaacaatatattggcatattgtgattctttgtaattgactataaattggttttgaaatgtccaaacatacgttgtgtgtctttatattgtactgtgtgttttaagtaactggcagaaaaagaattggaaatgaaatttccaatcagacaatgtagtattaaagaaaactttgttttaaatatgcggtaccatgtaaaattactcgtgttaggaataaagtccactgttgaagttgaatgtcactaagcttattatgttaaaaggaaccagtgtgattaggaaaacctaccagaagccagatacagtgtggtacgtgcaacatttcatgcacattttgattttgtttgtcattcaaaattgtgcttgtaaaaatgtatacaatttctgagttttataatttctaggtacttgttttttcttgctggtaaatagcttttttttaaaaaaaaatctaatataaaagaaaccatgtttatattttgttagtgatcaatgactttgtttatatggaaatttgtatattgttggcacacattttgttgaggtttacgtgcatgaaggcctgcaataattagcacaatgaaaactgctttttcttacatgttcatttttttgaaagattgtggtgcaaaggcttactctaataagtaaccttctggactatg

SEQ ID NO: 155008 - DNA, 3529 bp, Homo sapiens
  Payload ID: 10474
  Gene Symbol: MAP3K3
  Gene Name: mitogen-activated protein kinase kinase kinase 3
  Uniprot ID: Q99759
  ENST ID: ENST00000361733
  CDS Start-End: 321-2201
ggagaacggtggccggacggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccagagcgcagcccgcgccccccgcgcggagccaggcccgctgccgtccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaa

SEQ ID NO: 155009 - DNA, 4818 bp, Homo sapiens
  Payload ID: 10474
  Gene Symbol: MAP3K3
  Gene Name: mitogen-activated protein kinase kinase kinase 3
  Uniprot ID: Q99759
  ENST ID: ENST00000361357
  CDS Start-End: 319-2292
agaacggtggccggacggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccagagcgcagcccgcgccccccgcgcggagccaggcccgctgccgtccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagaaaaaacacaacagcagcagctcagcccttctgaacagccccacagtaacaacaagctcatgtgcaggggccagtgagaaaaagaaatttttgagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcattta

SEQ ID NO: 155010 - DNA, 3352 bp, Homo sapiens
  Payload ID: 10474
  Gene Symbol: MAP3K3
  Gene Name: mitogen-activated protein kinase kinase kinase 3
  Uniprot ID: Q99759
  ENST ID: ENST00000579585
  CDS Start-End: 67-2040
ttgtttttcggagcgttcctgaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagaaaaaacacaacagcagcagctcagcccttctgaacagccccacagtaacaacaagctcatgtgcaggggccagtgagaaaaagaaatttttgagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaagg

SEQ ID NO: 155011 - DNA, 2016 bp, Homo sapiens
  Payload ID: 10474
  Gene Symbol: MAP3K3
  Gene Name: mitogen-activated protein kinase kinase kinase 3
  ENST ID: ENST00000577395
  CDS Start-End: 51-1919
tgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgt

SEQ ID NO: 155012 - DNA, 2024 bp, Homo sapiens
  Payload ID: 10474
  Gene Symbol: MAP3K3
  Gene Name: mitogen-activated protein kinase kinase kinase 3
  ENST ID: ENST00000577597
  CDS Start-End: 51-221
tgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaatagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgt

SEQ ID NO: 155013 - DNA, 2480 bp, Homo sapiens
  Payload ID: 10474
  Gene Symbol: MAP3K3
  Gene Name: mitogen-activated protein kinase kinase kinase 3
  ENST ID: ENST00000584573
  CDS Start-End: 336-2297
gagcgttcctgaggtggagaacggtggccggacggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccagagcgcagcccgcgccccccgcgcggagccaggcccgctgccgtccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagaaaaaacacaacagcagcagctcagcccttctgaacagccccacagtaacaacaagctcatgtgcaggggccagtgagaaaaagaaatttttgagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcct

SEQ ID NO: 155014 - DNA, 580 bp, Homo sapiens
  Payload ID: 10474
  Gene Symbol: MAP3K3
  Gene Name: mitogen-activated protein kinase kinase kinase 3
  ENST ID: ENST00000581732
  CDS Start-End: 1-128
atttgtgctatgacgtggacacgggacgtgaacttgcttccaagcaggtccaatttgatccagacagtcctgagacaagcaagttcccaaggcagatccctgtgaggccactaactagggcaagctgagctgaacccaggcgggcagaactagggccctgagagctgaggcgaccactgacccctcccctaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactgga

SEQ ID NO: 155015 - DNA, 678 bp, Homo sapiens
  Payload ID: 10474
  Gene Symbol: MAP3K3
  Gene Name: mitogen-activated protein kinase kinase kinase 3
  ENST ID: ENST00000585302
  CDS Start-End: 1-95
aggcttcccagtccgcaggggatataaatactatctaccagccccccgagcccagaagcaggcacctctctgtcagtagaattgcttcaaattgaagtgtcctctgaagatcctgagctgagcttgagagatctaagcactgatcctgttgctgagtttgtctgtttgcaatatgcctcctgagggagttacaggaaaaatatgtttctgaggtactgactttgccttactgagtaacttctggaatccaggcaagtactggtaatgtttgagtgcttgctgtgtgctggtacagacaagactttctggaagggaaacagagacagaagtcaaggctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaag

SEQ ID NO: 155016 - DNA, 5295 bp, Homo sapiens
  Payload ID: 10475
  Gene Symbol: MAP3K4
  Gene Name: mitogen-activated protein kinase kinase kinase 4
  ENST ID: ENST00000348824
  CDS Start-End: 119-4783
cctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacagccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagc

SEQ ID NO: 155017 - DNA, 5397 bp, Homo sapiens
  Payload ID: 10475
  Gene Symbol: MAP3K4
  Gene Name: mitogen-activated protein kinase kinase kinase 4
  Uniprot ID: Q9Y6R4
  ENST ID: ENST00000366919
  CDS Start-End: 206-4882
gatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagctca

SEQ ID NO: 155018 - DNA, 5445 bp, Homo sapiens
  Payload ID: 10475
  Gene Symbol: MAP3K4
  Gene Name: mitogen-activated protein kinase kinase kinase 4
  ENST ID: ENST00000366920
  CDS Start-End: 119-4933
cctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacagccattcatcggaacagcccccgtcctatgaaggtacctcgatgccatagtgaccctcctaacccacacctcattatccccactccagagggattcagcactcggagcatgccttccgacgcgcggagccatggcagccctgctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagc

SEQ ID NO: 155019 - DNA, 5490 bp, Homo sapiens
  Payload ID: 10475
  Gene Symbol: MAP3K4
  Gene Name: mitogen-activated protein kinase kinase kinase 4
  Uniprot ID: Q9Y6R4
  ENST ID: ENST00000392142
  CDS Start-End: 149-4975
gtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcagcactcggagcatgccttccgacgcgcggagccatggcagccctgctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagctca

SEQ ID NO: 155020 - DNA, 225 bp, Homo sapiens
  Payload ID: 10475
  Gene Symbol: MAP3K4
  Gene Name: mitogen-activated protein kinase kinase kinase 4
  ENST ID: ENST00000448119
  CDS Start-End: 156-225
cttcctggaacgcagagtgtaatccctgcatttggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaag

SEQ ID NO: 155021 - DNA, 629 bp, Homo sapiens
  Payload ID: 10475
  Gene Symbol: MAP3K4
  Gene Name: mitogen-activated protein kinase kinase kinase 4
  ENST ID: ENST00000542952
  CDS Start-End: 164-421
gctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgca

SEQ ID NO: 155022 - DNA, 5444 bp, Homo sapiens
  Payload ID: 10475
  Gene Symbol: MAP3K4
  Gene Name: mitogen-activated protein kinase kinase kinase 4
  ENST ID: ENST00000544041
  CDS Start-End: 89-4417
cgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcagcactcggagcatgccttccgacgcgcggagccatggcagccctgctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagaagcacagtaactttgcctaattctcaggaaatctccatgagttacatcatttctgccttctctctgaaactagaggagttcctcctaaaatgaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggttt

SEQ ID NO: 155023 - DNA, 5451 bp, Homo sapiens
  Payload ID: 10475
  Gene Symbol: MAP3K4
  Gene Name: mitogen-activated protein kinase kinase kinase 4
  ENST ID: ENST00000490904
  CDS Start-End: 89-1999
cgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagggagacatgagacatcaatcaatatatgtaagatgtacattggttccatccagaaagacaggacaactcgaagcagggatggggcttgcaggtcacagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcagcactcggagcatgccttccgacgcgcggagccatggcagccctgctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggttt

SEQ ID NO: 155024 - DNA, 5197 bp, Homo sapiens
  Payload ID: 10476
  Gene Symbol: MAP3K5
  Gene Name: mitogen-activated protein kinase kinase kinase 5
  Uniprot ID: Q99683
  ENST ID: ENST00000359015
  CDS Start-End: 362-4486
cgagcgcggcgcccttgagctgcaccgcggcgcaggtttgcgagccgacttgtcagccggccaagaaaaggaagctccgtcccttcccgctcacccggcttccccaccccttgtactctaaactctgcagagggcgagcggcgcggccacggaggcgccgaggaggagcgagccgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 155025 - DNA, 4136 bp, Homo sapiens
  Payload ID: 10477
  Gene Symbol: MAP3K6
  Gene Name: mitogen-activated protein kinase kinase kinase 6
  Uniprot ID: O95382
  ENST ID: ENST00000357582
  CDS Start-End: 270-4136
tgagctgccgatcaccggatgccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctga

SEQ ID NO: 155026 - DNA, 4309 bp, Homo sapiens
  Payload ID: 10477
  Gene Symbol: MAP3K6
  Gene Name: mitogen-activated protein kinase kinase kinase 6
  Uniprot ID: O95382
  ENST ID: ENST00000374040
  CDS Start-End: 262-4104
cgatcaccggatgccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttg

SEQ ID NO: 155027 - DNA, 2530 bp, Homo sapiens
  Payload ID: 10477
  Gene Symbol: MAP3K6
  Gene Name: mitogen-activated protein kinase kinase kinase 6
  ENST ID: ENST00000472410
  CDS Start-End: 1-2396
tcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaa

SEQ ID NO: 155028 - DNA, 444 bp, Homo sapiens
  Payload ID: 10477
  Gene Symbol: MAP3K6
  Gene Name: mitogen-activated protein kinase kinase kinase 6
  ENST ID: ENST00000486046
  CDS Start-End: 1-248
gggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaa

SEQ ID NO: 155029 - DNA, 4309 bp, Homo sapiens
  Payload ID: 10477
  Gene Symbol: MAP3K6
  Gene Name: mitogen-activated protein kinase kinase kinase 6
  Uniprot ID: O95382
  ENST ID: ENST00000493901
  CDS Start-End: 241-4107
gattcccaggatcccccaagtggctctgagctgccgatcaccggatgccccagattcctgggacccaatcccggatttcagaacctcaggaccttgcaagtccgagctaggatttctccctggactttagattcctggaacgggacgtcaggccatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacactt

SEQ ID NO: 155030 - DNA, 3328 bp, Homo sapiens
  Payload ID: 10478
  Gene Symbol: MAP3K7
  Gene Name: mitogen-activated protein kinase kinase kinase 7
  ENST ID: ENST00000369320
  CDS Start-End: 1728-2510
cataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaa

SEQ ID NO: 155031 - DNA, 4633 bp, Homo sapiens
  Payload ID: 10478
  Gene Symbol: MAP3K7
  Gene Name: mitogen-activated protein kinase kinase kinase 7
  Uniprot ID: O43318
  ENST ID: ENST00000369325
  CDS Start-End: 1-1557
atgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 155032 - DNA, 4558 bp, Homo sapiens
  Payload ID: 10478
  Gene Symbol: MAP3K7
  Gene Name: mitogen-activated protein kinase kinase kinase 7
  Uniprot ID: O43318
  ENST ID: ENST00000369327
  CDS Start-End: 7-1482
gggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 155033 - DNA, 4911 bp, Homo sapiens
  Payload ID: 10478
  Gene Symbol: MAP3K7
  Gene Name: mitogen-activated protein kinase kinase kinase 7
  Uniprot ID: O43318
  ENST ID: ENST00000369329
  CDS Start-End: 163-1983
ggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 155034 - DNA, 4830 bp, Homo sapiens
  Payload ID: 10478
  Gene Symbol: MAP3K7
  Gene Name: mitogen-activated protein kinase kinase kinase 7
  Uniprot ID: O43318
  ENST ID: ENST00000369332
  CDS Start-End: 163-1902
ggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggta

SEQ ID NO: 155035 - DNA, 3096 bp, Homo sapiens
  Payload ID: 10479
  Gene Symbol: MAP3K8
  Gene Name: mitogen-activated protein kinase kinase kinase 8
  Uniprot ID: P41279
  ENST ID: ENST00000263056
  CDS Start-End: 697-2100
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccgtgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgcctt

SEQ ID NO: 155036 - DNA, 2518 bp, Homo sapiens
  Payload ID: 10479
  Gene Symbol: MAP3K8
  Gene Name: mitogen-activated protein kinase kinase kinase 8
  Uniprot ID: P41279
  ENST ID: ENST00000375321
  CDS Start-End: 118-1521
aaatcctgttgccaatccttgtatgtcagtttcccatgggtcttgaatgcaaatacaaatatcgtaaactaaatatttgtgttttctttcctagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccgtgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgcctta

SEQ ID NO: 155037 - DNA, 932 bp, Homo sapiens
  Payload ID: 10479
  Gene Symbol: MAP3K8
  Gene Name: mitogen-activated protein kinase kinase kinase 8
  ENST ID: ENST00000375322
  CDS Start-End: 390-788
cttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctactgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcata

SEQ ID NO: 155038 - DNA, 776 bp, Homo sapiens
  Payload ID: 10479
  Gene Symbol: MAP3K8
  Gene Name: mitogen-activated protein kinase kinase kinase 8
  ENST ID: ENST00000413724
  CDS Start-End: 108-776
cgcggggaagcggggacccgctgtcactgcgcctcccgctgccgacgccgcctggacggccgcactctccctgcccgagacccgactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtgga

SEQ ID NO: 155039 - DNA, 1026 bp, Homo sapiens
  Payload ID: 10479
  Gene Symbol: MAP3K8
  Gene Name: mitogen-activated protein kinase kinase kinase 8
  ENST ID: ENST00000415139
  CDS Start-End: 262-1026
gggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaa

SEQ ID NO: 155040 - DNA, 2782 bp, Homo sapiens
  Payload ID: 10479
  Gene Symbol: MAP3K8
  Gene Name: mitogen-activated protein kinase kinase kinase 8
  Uniprot ID: P41279
  ENST ID: ENST00000542547
  CDS Start-End: 382-1785
accctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccgtgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgcctta

SEQ ID NO: 155041 - DNA, 4025 bp, Homo sapiens
  Payload ID: 10480
  Gene Symbol: MAP3K9
  Gene Name: mitogen-activated protein kinase kinase kinase 9
  ENST ID: ENST00000381250
  CDS Start-End: 336-3581
ggagagcggcggccggctggcagcggcgggcaccggctgcgcgagcaggtaccggcggcagaggtgacgaggccgcccccgggggggcgagcgggcaggcggggactcggcccgctgcgcccctaggctgcgcgaagagctcgcgctcggcgctcttctcgtaccgcggtaacagcgccggcgagccggctctcccagccctgccagcccgggccctacctgcggccgccgtcgttgggggggggtcctcccagctctgcggaggcgcatgaacaataggcggcggcggctcctgcgggcggcggcggccccgcaccctatggatcggccgctccatggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggcctcaagtccctggtagatggatataagcagtggtcgtccagtgcccccaacctggtgaagggcccaaggagtagcccggccctgccagggttcaccagccttatggagatggaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcc

SEQ ID NO: 155042 - DNA, 3544 bp, Homo sapiens
  Payload ID: 10480
  Gene Symbol: MAP3K9
  Gene Name: mitogen-activated protein kinase kinase kinase 9
  ENST ID: ENST00000553414
  CDS Start-End: 317-2830
gggaggaattttgagcaggaaatgagggagcttctttctataaggacagtggatggaattaaaaaggggtatttgaggaagcgttgctgtggatcatatgaaacctttggatgctcaagaaaaataagagtcagactaatttgaatttactttaggatgccgtcttccttcccaccttaccgttgtttggacacagtactgtcctgggcttctaacattattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagtgtgagactgtttcccaaattagctggggccagaacacacaggggcacctgtcccctgctctgtccagccaccgactggtccaggcttgctccatccataacttctgccacctctcctcgacaatgtgtatatacatgcacatattgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaa

SEQ ID NO: 155043 - DNA, 4449 bp, Homo sapiens
  Payload ID: 10480
  Gene Symbol: MAP3K9
  Gene Name: mitogen-activated protein kinase kinase kinase 9
  Uniprot ID: P80192
  ENST ID: ENST00000555993
  CDS Start-End: 364-3720
gggggcggggcacggcacggcgcggagaggagagcggcggccggctggcagcggcgggcaccggctgcgcgagcaggtaccggcggcagaggtgacgaggccgcccccgggggggcgagcgggcaggcggggactcggcccgctgcgcccctaggctgcgcgaagagctcgcgctcggcgctcttctcgtaccgcggtaacagcgccggcgagccggctctcccagccctgccagcccgggccctacctgcggccgccgtcgttgggggggggtcctcccagctctgcggaggcgcatgaacaataggcggcggcggctcctgcgggcggcggcggccccgcaccctatggatcggccgctccatggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggatcccctcagagacgtgagaaagctaatggtttaagtaccccatcagaatctccacatttccacttgggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagta

SEQ ID NO: 155044 - DNA, 11169 bp, Homo sapiens
  Payload ID: 10480
  Gene Symbol: MAP3K9
  Gene Name: mitogen-activated protein kinase kinase kinase 9
  Uniprot ID: P80192
  ENST ID: ENST00000554752
  CDS Start-End: 1-3315
atggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggatcccctcagagacgtgagaaagctaatggtttaagtaccccatcagaatctccacatttccacttgggcctcaagtccctggtagatggatataagcagtggtcgtccagtgcccccaacctggtgaagggcccaaggagtagcccggccctgccagggttcaccagccttatggagatggaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctcaaaaaaaaaaaaaaaaaaaaaaaaagtctgttctgtggcctccttcccccgggccctccataacctcaggctaaaccatgagcacatctgtatatccttggctccactaaatggccctcttgtggccctccaaaccatgctgcctatacacagtgctctgtggtatgaagcagagatttttcctttgctcatttttaacttttgccattgtggtaggttgcagccatctttctagatgtagtgtaactgatgtagtgtaactgaatgatggtcacctgccattgagtgagaggttgagtgccatccttacttgtccactgtggggaaagataaagcaagcctgggtctttgctaaggaaataattgtacctgaaagaagcaaaagcagggctatccaaaggtgctactgtgagcatccatgaagaaggaacagttaccatctctcagctcctacacacctggtctctgatgggcccctgactgctgcactctctcagtggggcaaggttggagatgggctaaggatctgtatagtagtagcaggtctcagtggctttctattcgctcaggttcccttgttctgtggtcctggtcgggagcaggccctggagctgtggatgaagccacttgagtggcagtagccggcccccctttcctctgccttccctttgcacaaagacacgttccttctgctcttggcaggtgctaacttcatggaagatggtaataggaacagatactgctctctgcccctgcttcttggattcttcagctcctaccgctgattcggattatccccttttgaccctcttggggatccagactgctgccaggaggctgagtagatacctcagttatctgtatgttatttctgagaggctttggcggatcctcttcacttggcatcctgtggcatccctagggtctggtggtagcagtaatagcaacaatgatatcttacatctggacaactcagaatagtgctaacttttcctcctgacctttgcaaaatgacatcattttccttgtacatttgatacccttgctagtagagaaggggaaatgcttaaagatgaaaattcaagtgaagagaaatgaaaaagtggcttggactaattgctgagtgaggccactgggctcagaactgaacaggttggctgcattccccattctgcttttgctgtgtggccataggcttgtctctttagcccctctcagatttccttcctttaaaagcaatcatcacatgctttcctctcaagggagttgggtgtatgtatcagagaaggtcagtgaaacaccatagctccttgccagctcctagaggaagcttctttcatctatacaggatgaatcgctgaagttgagagtgtggctctcatcacctttgccttgagggaacttgccttttctttcgtcctttggcttctggaagaggagtgatttggaggtggttgagcatgactaatgggggccctggtcgggcccatgcccttctgccgcatttatatagcatctggtgttgacaagcattctttcctaattcccccacttaacttgtctgatgctgtctgccaatgtcatcctcaccacttgtgtcttacagagaaggaaatgggagagggaggttgtgtcttacagagaaggaaatgagagagggaggttggtagcaacatcagagtgacagttggctgtctctcatttcttggggtcatcagtctgatttgtttagagcctgggatcatcccagttcctggaagaatctttggaaaagggtccccttgttcttgggacatgtgtcatggtcactaagccccctttccctcaggctactgttgctcagggacacaatgagataccccaaggacatctagacctgacttttcatgaactctcttgcctctgtggtccccacattggagacctccctccctcctccttcccttgtgtgaaggagacacctcccgagcaatcctaactcatccagctcacttttaacaaagcaaagagcagagggcactgaagactggatggctgtgaatggtacaccttggggttgaaaccgtgttggcaggaacctggtgataaaagctgcctacttcctgggtgtgtgaatttgcacatatcttttcccctcactggacttcagaagcctactgtgaactggggacgatgctatctactttccctcctgaagcccttctaactttcaaatgtatggtcctggggccatgagtcctgcacagaaactgcagccttgccagattgcttcccttggtgcagaaaagtgtgtgtgtgtgtgtgtgtgaaatatacgtacggttttacgtcaaaaacagtcgaatatcagctatttcatatggttcaccctaatgtacctgcctctctctttggctttaggtctgagaatgacttgtctttgtcaaggtatactattgttagaaacgcattaccaaatgcatctcttctgtcggatcagcgtattcctagattaggaattcaaattaatgaaaattcacatatgaaaggaaaatccattgctatttctggagaggacctcagtcctgggcttttccctggcattgctacctgggtgggtgctcaccactcaggtgctggtgttggaaggcaggaggaggaagctgaaatcctgccgattaaggctaattaacagggtttaggtgcctaattatcatgactcagcccgggacttatggttagccgtgcaggccaggtgagtctcttatggacttcctctcagactgctctttctcattttgtcctgatgagatattgacagtcatgtccacccgcttcctcatccatttcccgtcttgggccctggaagtacgggggcctctgtaggctgcctagggagccctggctttgctcttcgtgttgggctcactccatgatcaggagccggtgggactggtccttcctgattcttactgtctgtggttccccatcccctacggggagcctgctttgggccttgagctggatagagagaagagctttggggcccagctggttataggagctgagcttttccacacctctctttgttaacccttggaaacagacctgcctttcacctgacccatcttcctacctgtctggtctgacctgccctctttgaaagcactcatcacctagttttactaggctgattggcagatgtggacatgacaggtgtctatcgagataggtgtctaactagttaggtgtctcaggattggacagcagaataccattccaggggtgcacagacaggcctctcctaccggaacatgagggatagacgtctgggcattctgaacccagaggtcagagtagtcacaagcggagccctggggagcgagggccccagggccgtggtgttccttgccctgcgctcactgaagtccaaggccaggtttcagaaatagtgtgctgcctgttcctgagatccttcacacctggacaccaacccagacaaagcctgacttaaaattttgatactgtattcatcgtggaatttttcaataactctgatttttaaaaaatactgcattgcaatatgatttaccttgattactgaggctcttttttttttggcacccctttaaattttaacccaaggtgagggcctcactccactctatacccagccctgcctgcccctcacctggacctgtgagaggggcttaggtaccactgtgaaatacgttttaaatttttacttgcccttcccctcaggtcctgagtgaggcagtggctctctggcggtgctcgcatttaaataggagtgtgtaggcttacagcaatgaaacatctaggagcttttaactttggatctatacctgggtgtgacatttccttggtgttctctggctgcctttctggctctgcagccctgagggcacttgtgtgtgtgtgtgttctctggagaagggaagtgattatggcagagaggctcctttagattctcctcttaaacctctttggaacatgtttgaattccagaagtgaatgaacttcattcattctctcgtccagatttcagaagggactaaagtgaacggaggctttttcactccctggcatgctaagagccacattccctagctctgtgcctgcacagtgagtcttcagaatttggcccatcacaccctctgctagtatcgtttccaccaccctcctcatcctctgtcatctttatttcattctcatcgtttatctctacctccagttcagatgccatgctggctgtggctcttttcttcatcaccatcagagtgaggcaaagatgtatcctggcctagttataaagacgaataatacatgataagaaatcattaatttttttccacgtggggggcggtgctgtcctagtgattcatatatatataatttttgactccttacaataattctgggatgtgggtattacccccatttaagaatgtggaaaccaaggctctgatggctctgtaatttgcccagggtcacacagctaggaagcaagttgctgatctgcttggttccaaagtcacctctctttttcctctgagcacatttctaagccactacttagaagctcttgagataaagttggcctagctcaggtccaccgaggttttgagattgccctttgcccaaggaggagttgtgtccttggctcacctgtcatctgcctgtgactggacttgaaccctcgcacgtctcagctgacatccttgatgctgctggctgccttcctcgccctgtttcctctccatgactccaggggtttgaagcacacaggagctggacatgtcaattctgtagctcttctcccaataccactgaaggccgtgagcctctctcctgtttccagcctgcaggtgccctgttgctgctcttcattccagcttctcctcacttttctctcagtctcttgagcttggaagccttattgtagcttgtgtctcctccctgggcacttgaggtcaggcttttgcctttttgtcacattgagccacatgcctttgatacacagttgtagcaaagaagggaggtgatgaacttgctcactttcttttctgatttccctccctactcatcctgcactccccaccgaaacccagatatcttatagtctaaggcttgtagaggattaaggaaaggaattggagatgggttttacttagttcacagaaaagctttctttgggatttttcctcccccttagggcttttaagtctaggtgaagtgaaagttcacacatgtgtttgtttggttgctctgtaattagctactagtttttatccctagaccttctctgctccagtgtcttgttcatgtgtcctgaccccgtgtccttgaattcccactttgctttgggatttaagttattgtatgttgtcaacaatatttaaagatgaaaaagtcctgaaggaaacttaccaggttctttcctttggcttttttttttttttctttcgaggtactgtaaattgttaactagggatgccaagcaggcttggttcaatggctaaacctcttattgtattacagtgtaatgctgatctcagcctggtctcaatgccagagcacacagagacttgaataaaactgttataacgatta

SEQ ID NO: 155045 - DNA, 2982 bp, Homo sapiens
  Payload ID: 10480
  Gene Symbol: MAP3K9
  Gene Name: mitogen-activated protein kinase kinase kinase 9
  ENST ID: ENST00000554146
  CDS Start-End: 239-2737
cttttgggaggaattttgagcaggaaatgagggagcttctttctataaggacagtggatggaattaaaaaggggtatttgaggaagcgttgctgtggatcatatgaaacctttggatgctcaagaaaaataagagtcagactaatttgaatttactttaggatgccgtcttccttcccaccttaccgttgtttggacacagtactgtcctgggcttctaacataacactcaccatgaaatggagcttacaggactggaagttgccctggtattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaag

SEQ ID NO: 155046 - DNA, 10497 bp, Homo sapiens
  Payload ID: 10480
  Gene Symbol: MAP3K9
  Gene Name: mitogen-activated protein kinase kinase kinase 9
  ENST ID: ENST00000611979
  CDS Start-End: 1-2643
atggagcttacaggactggaagttgccctggtattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagtgtgagactgtttcccaaattagctggggccagaacacacaggggcacctgtcccctgctctgtccagccaccgactggtccaggcttgctccatccataacttctgccacctctcctcgacaatgtgtatatacatgcacatattgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctcaaaaaaaaaaaaaaaaaaaaaaaaagtctgttctgtggcctccttcccccgggccctccataacctcaggctaaaccatgagcacatctgtatatccttggctccactaaatggccctcttgtggccctccaaaccatgctgcctatacacagtgctctgtggtatgaagcagagatttttcctttgctcatttttaacttttgccattgtggtaggttgcagccatctttctagatgtagtgtaactgatgtagtgtaactgaatgatggtcacctgccattgagtgagaggttgagtgccatccttacttgtccactgtggggaaagataaagcaagcctgggtctttgctaaggaaataattgtacctgaaagaagcaaaagcagggctatccaaaggtgctactgtgagcatccatgaagaaggaacagttaccatctctcagctcctacacacctggtctctgatgggcccctgactgctgcactctctcagtggggcaaggttggagatgggctaaggatctgtatagtagtagcaggtctcagtggctttctattcgctcaggttcccttgttctgtggtcctggtcgggagcaggccctggagctgtggatgaagccacttgagtggcagtagccggcccccctttcctctgccttccctttgcacaaagacacgttccttctgctcttggcaggtgctaacttcatggaagatggtaataggaacagatactgctctctgcccctgcttcttggattcttcagctcctaccgctgattcggattatccccttttgaccctcttggggatccagactgctgccaggaggctgagtagatacctcagttatctgtatgttatttctgagaggctttggcggatcctcttcacttggcatcctgtggcatccctagggtctggtggtagcagtaatagcaacaatgatatcttacatctggacaactcagaatagtgctaacttttcctcctgacctttgcaaaatgacatcattttccttgtacatttgatacccttgctagtagagaaggggaaatgcttaaagatgaaaattcaagtgaagagaaatgaaaaagtggcttggactaattgctgagtgaggccactgggctcagaactgaacaggttggctgcattccccattctgcttttgctgtgtggccataggcttgtctctttagcccctctcagatttccttcctttaaaagcaatcatcacatgctttcctctcaagggagttgggtgtatgtatcagagaaggtcagtgaaacaccatagctccttgccagctcctagaggaagcttctttcatctatacaggatgaatcgctgaagttgagagtgtggctctcatcacctttgccttgagggaacttgccttttctttcgtcctttggcttctggaagaggagtgatttggaggtggttgagcatgactaatgggggccctggtcgggcccatgcccttctgccgcatttatatagcatctggtgttgacaagcattctttcctaattcccccacttaacttgtctgatgctgtctgccaatgtcatcctcaccacttgtgtcttacagagaaggaaatgggagagggaggttgtgtcttacagagaaggaaatgagagagggaggttggtagcaacatcagagtgacagttggctgtctctcatttcttggggtcatcagtctgatttgtttagagcctgggatcatcccagttcctggaagaatctttggaaaagggtccccttgttcttgggacatgtgtcatggtcactaagccccctttccctcaggctactgttgctcagggacacaatgagataccccaaggacatctagacctgacttttcatgaactctcttgcctctgtggtccccacattggagacctccctccctcctccttcccttgtgtgaaggagacacctcccgagcaatcctaactcatccagctcacttttaacaaagcaaagagcagagggcactgaagactggatggctgtgaatggtacaccttggggttgaaaccgtgttggcaggaacctggtgataaaagctgcctacttcctgggtgtgtgaatttgcacatatcttttcccctcactggacttcagaagcctactgtgaactggggacgatgctatctactttccctcctgaagcccttctaactttcaaatgtatggtcctggggccatgagtcctgcacagaaactgcagccttgccagattgcttcccttggtgcagaaaagtgtgtgtgtgtgtgtgtgtgaaatatacgtacggttttacgtcaaaaacagtcgaatatcagctatttcatatggttcaccctaatgtacctgcctctctctttggctttaggtctgagaatgacttgtctttgtcaaggtatactattgttagaaacgcattaccaaatgcatctcttctgtcggatcagcgtattcctagattaggaattcaaattaatgaaaattcacatatgaaaggaaaatccattgctatttctggagaggacctcagtcctgggcttttccctggcattgctacctgggtgggtgctcaccactcaggtgctggtgttggaaggcaggaggaggaagctgaaatcctgccgattaaggctaattaacagggtttaggtgcctaattatcatgactcagcccgggacttatggttagccgtgcaggccaggtgagtctcttatggacttcctctcagactgctctttctcattttgtcctgatgagatattgacagtcatgtccacccgcttcctcatccatttcccgtcttgggccctggaagtacgggggcctctgtaggctgcctagggagccctggctttgctcttcgtgttgggctcactccatgatcaggagccggtgggactggtccttcctgattcttactgtctgtggttccccatcccctacggggagcctgctttgggccttgagctggatagagagaagagctttggggcccagctggttataggagctgagcttttccacacctctctttgttaacccttggaaacagacctgcctttcacctgacccatcttcctacctgtctggtctgacctgccctctttgaaagcactcatcacctagttttactaggctgattggcagatgtggacatgacaggtgtctatcgagataggtgtctaactagttaggtgtctcaggattggacagcagaataccattccaggggtgcacagacaggcctctcctaccggaacatgagggatagacgtctgggcattctgaacccagaggtcagagtagtcacaagcggagccctggggagcgagggccccagggccgtggtgttccttgccctgcgctcactgaagtccaaggccaggtttcagaaatagtgtgctgcctgttcctgagatccttcacacctggacaccaacccagacaaagcctgacttaaaattttgatactgtattcatcgtggaatttttcaataactctgatttttaaaaaatactgcattgcaatatgatttaccttgattactgaggctcttttttttttggcacccctttaaattttaacccaaggtgagggcctcactccactctatacccagccctgcctgcccctcacctggacctgtgagaggggcttaggtaccactgtgaaatacgttttaaatttttacttgcccttcccctcaggtcctgagtgaggcagtggctctctggcggtgctcgcatttaaataggagtgtgtaggcttacagcaatgaaacatctaggagcttttaactttggatctatacctgggtgtgacatttccttggtgttctctggctgcctttctggctctgcagccctgagggcacttgtgtgtgtgtgtgttctctggagaagggaagtgattatggcagagaggctcctttagattctcctcttaaacctctttggaacatgtttgaattccagaagtgaatgaacttcattcattctctcgtccagatttcagaagggactaaagtgaacggaggctttttcactccctggcatgctaagagccacattccctagctctgtgcctgcacagtgagtcttcagaatttggcccatcacaccctctgctagtatcgtttccaccaccctcctcatcctctgtcatctttatttcattctcatcgtttatctctacctccagttcagatgccatgctggctgtggctcttttcttcatcaccatcagagtgaggcaaagatgtatcctggcctagttataaagacgaataatacatgataagaaatcattaatttttttccacgtggggggcggtgctgtcctagtgattcatatatatataatttttgactccttacaataattctgggatgtgggtattacccccatttaagaatgtggaaaccaaggctctgatggctctgtaatttgcccagggtcacacagctaggaagcaagttgctgatctgcttggttccaaagtcacctctctttttcctctgagcacatttctaagccactacttagaagctcttgagataaagttggcctagctcaggtccaccgaggttttgagattgccctttgcccaaggaggagttgtgtccttggctcacctgtcatctgcctgtgactggacttgaaccctcgcacgtctcagctgacatccttgatgctgctggctgccttcctcgccctgtttcctctccatgactccaggggtttgaagcacacaggagctggacatgtcaattctgtagctcttctcccaataccactgaaggccgtgagcctctctcctgtttccagcctgcaggtgccctgttgctgctcttcattccagcttctcctcacttttctctcagtctcttgagcttggaagccttattgtagcttgtgtctcctccctgggcacttgaggtcaggcttttgcctttttgtcacattgagccacatgcctttgatacacagttgtagcaaagaagggaggtgatgaacttgctcactttcttttctgatttccctccctactcatcctgcactccccaccgaaacccagatatcttatagtctaaggcttgtagaggattaaggaaaggaattggagatgggttttacttagttcacagaaaagctttctttgggatttttcctcccccttagggcttttaagtctaggtgaagtgaaagttcacacatgtgtttgtttggttgctctgtaattagctactagtttttatccctagaccttctctgctccagtgtcttgttcatgtgtcctgaccccgtgtccttgaattcccactttgctttgggatttaagttattgtatgttgtcaacaatatttaaagatgaaaaagtcctgaaggaaacttaccaggttctttcctttggcttttttttttttttctttcgaggtactgtaaattgttaactagggatgccaagcaggcttggttcaatggctaaacctcttattgtattacagtgtaatgctgatctcagcctggtctcaatgccagagcacacagagacttgaataaaactgttataacgatta

SEQ ID NO: 155047 - DNA, 2653 bp, Homo sapiens
  Payload ID: 10481
  Gene Symbol: MAP4K1
  Gene Name: mitogen-activated protein kinase kinase kinase kinase 1
  Uniprot ID: Q92918
  ENST ID: ENST00000396857
  CDS Start-End: 109-2574
gcggaggcaaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatc

SEQ ID NO: 155048 - DNA, 2700 bp, Homo sapiens
  Payload ID: 10481
  Gene Symbol: MAP4K1
  Gene Name: mitogen-activated protein kinase kinase kinase kinase 1
  Uniprot ID: Q92918
  ENST ID: ENST00000591517
  CDS Start-End: 30-2531
gggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggctggagtgcagtggcacgatctcgcctcactgcaacctcctcctcccaggttcaagcaattctcctgcctcagcctcccgagtagctgggattacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 155049 - DNA, 1625 bp, Homo sapiens
  Payload ID: 10481
  Gene Symbol: MAP4K1
  Gene Name: mitogen-activated protein kinase kinase kinase kinase 1
  ENST ID: ENST00000591921
  CDS Start-End: 1-1577
gctccagctctctggggatcccagatgcagactgctgtcggcggcacatggagttcaggaagctccgaggaatggagaccagacccccagccaacaccgctcgcctacagcctcctcgagacctcaggagcagcagccccaggtcagggaccccagggaggatggggagggggctggaatgtggacaaggcccccaaggctcatacctgtcacccttcaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccata

SEQ ID NO: 155050 - DNA, 1363 bp, Homo sapiens
  Payload ID: 10481
  Gene Symbol: MAP4K1
  Gene Name: mitogen-activated protein kinase kinase kinase kinase 1
  ENST ID: ENST00000586296
  CDS Start-End: 72-1259
gggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctc

SEQ ID NO: 155051 - DNA, 2654 bp, Homo sapiens
  Payload ID: 10481
  Gene Symbol: MAP4K1
  Gene Name: mitogen-activated protein kinase kinase kinase kinase 1
  ENST ID: ENST00000589130
  CDS Start-End: 99-2552
acccggagctctggcggcgtgcgcgcgcgttgtattgcgcgcggccatgaggccacggagctctgcgggaatgcacgcagcagccttacgtttaggccatggccaagttccgagggagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcc

SEQ ID NO: 155052 - DNA, 1225 bp, Homo sapiens
  Payload ID: 10481
  Gene Symbol: MAP4K1
  Gene Name: mitogen-activated protein kinase kinase kinase kinase 1
  ENST ID: ENST00000585583
  CDS Start-End: 1-208
tggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatggaaagaccccccacctgtattctcatagcatccttggcctgctggaacggaaagagaccagagcaggaaaccccatcgctcacattagcccccaccgcctactggcaaggtaccagctcccaatgaatggcaccacacagccttataattcctcccatgcccctctgcctcctgctgtcctaccccccttcacacctacctattctccaggaagaacatggtttccaccaagatccaggacaccaaa

SEQ ID NO: 155053 - DNA, 2654 bp, Homo sapiens; identical to SEQ ID NO: 155051
  Payload ID: 10481
  Gene Symbol: MAP4K1
  Gene Name: mitogen-activated protein kinase kinase kinase kinase 1
  ENST ID: ENST00000634456
  CDS Start-End: 99-2552

SEQ ID NO: 155054 - DNA, 2700 bp, Homo sapiens; identical to SEQ ID NO: 155048
  Payload ID: 10481
  Gene Symbol: MAP4K1
  Gene Name: mitogen-activated protein kinase kinase kinase kinase 1
  ENST ID: ENST00000634395
  CDS Start-End: 30-2531

SEQ ID NO: 155055 - DNA, 1363 bp, Homo sapiens; identical to SEQ ID NO: 155050
  Payload ID: 10481
  Gene Symbol: MAP4K1
  Gene Name: mitogen-activated protein kinase kinase kinase kinase 1
  ENST ID: ENST00000634814
  CDS Start-End: 72-1259

SEQ ID NO: 155056 - DNA, 1225 bp, Homo sapiens; identical to SEQ ID NO: 155052
  Payload ID: 10481
  Gene Symbol: MAP4K1
  Gene Name: mitogen-activated protein kinase kinase kinase kinase 1
  ENST ID: ENST00000634236
  CDS Start-End: 1-208

SEQ ID NO: 155057 - DNA, 2653 bp, Homo sapiens; identical to SEQ ID NO: 155047
  Payload ID: 10481
  Gene Symbol: MAP4K1
  Gene Name: mitogen-activated protein kinase kinase kinase kinase 1
  ENST ID: ENST00000634494
  CDS Start-End: 109-2574

SEQ ID NO: 155058 - DNA, 1625 bp, Homo sapiens; identical to SEQ ID NO: 155049
  Payload ID: 10481
  Gene Symbol: MAP4K1
  Gene Name: mitogen-activated protein kinase kinase kinase kinase 1
  ENST ID: ENST00000634475
  CDS Start-End: 1-1577

SEQ ID NO: 155059 - DNA, 7178 bp, Homo sapiens
  Payload ID: 10482
  Gene Symbol: MAP4K2
  Gene Name: mitogen-activated protein kinase kinase kinase kinase 2
  Uniprot ID: Q12851
  ENST ID: ENST00000294066
  CDS Start-End: 93-2555
cagagccacgggcgcccgccccgccccgcgccgccccgcgccggctccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttagtcctctggtccctctgggtagggggagtgaacccacctcatctcccgcctccttccctccaacacacgtttctgtgggcaccacagaagggcagggcccccagggttttggagaagccaggtagaggtgacaggaggccatggcccccagcagccttctaggggcactgtgccttcccctgcatccttgctcagaactgaccctcagctttgcagtttgagggctctgctgtagtttagcaccccaaggactcatgcagatggggggacctcaacaaagggactctcatccagggcacccttgccccacgtaggatctcactgggtgacccctggaagggcccaggaggagcccccagagggctgttccctccattcccatggaggctgctgcccatggaggtagcctgtgtgacctgtatcccctgcctccacctactgcctaggtgttagaccaggaacatcagatgacagcacgatcatcagattggatgggaaggctagcctgtgtccgtctaccagactcccaagggctgcctcagtgccaggccctggggtcactaccagaaacagaccagcccccagggagggcgtcctccttgctggagcctgcatcttgagggcatggccattctcctgtagcttgtgcttacgctgtcattctccaagggtctgtctgctcagctctgaatgccagggcccccagggctgggcatcctcttttgccccaggcactgatcagccgctcttgactggagcctttgggcagctgcagcccaggaggcaggatgggaactgccttgagggcccacagctggggggctgggaaggtgggggcagggtggggggaacagctggagcaaaggccccatggtcacccctacattcaaggcaggtgttggaggaagacctttgcacctggtgggtggcaataaagacttgcggagtgacgtggtaggtggatggcagccatgcgagtaggctcagtggttcccagggtgtcacactgtcccctcagccaccctccagcagagtttcaactgttctgactctgtccagtgactgggagggtttcttggctggaatggggagccagcccaggggagggaacacatctcttcacaccaggcattcacacccatgttcccgtgagccccaaggagggtgaggggcaccttccaaattggggtcggtggtaacagggatacaaagtgaattcctaacttccaattttccagatttctcggaggaatgttgggaccagggtggggtaagtggggacagggaggtgagctcctgctcagcaaaggccctgaccaaaggcgccctggggaggactggctttccgttcaccaaccggccagcagcagacagtgcctccttgtggcggatcttcccggacctcagattcagtctggaaacggggtttggactgcagagtgtaaactgccaaagtgggggcctcccataaaacgcttgctgccagcaaaggcaggccaagagcaaagaaaggccgagaaaccagggaatatgcactgagagactaacactttaaattttatttatgtatttttaaatgcgtaacctttgcccatggtacatatttttttaaatacagcagagatataatgaagtctccctcttaccccgtccccagccaccctggtctcagttacttatgaacccttctagaagtattttgcgtatttaagcaatttggtatattttattcttggcgattttttatatacgtattaacatattccacatactgtactgaccttgccctttaaaaatatatcctggggggccaggtgtggtggctcacacctgtaatccaagcactttgggaggccgaggcgggcgaatcacgaggtcaggggttcgagaccagcctggccaacatggtgaaaccccgtctctactaaaaatacaaaaaattagctgggcatggtggcgagtgcctgtaatcccagctactcgggaggctgaggcaggagaatcgcttgaacctgggaggcggaggttgcagtgagcctagaacatgccactgcactccagcctgggcgacagtgcaagactccgtctcaaaaaaaaaaaaaagagaaaaaaatatatatatatcctggagaatatgaatgtattaaattatcacatgcaccctgaaaagatatgtatatatcctggagagttttgcgttaaagatctccctttaaaaaaaaatttttttttttttacagctagtggtattccattgtgtatgtttcccataacaaatgttaatgacctgcagtgagatccctattggtggaaatttgagttgtttttactacttttatattacaaacaatgctgcaataaatattattaggctagtgcccctctgtacatattcaagcacttctagaagataagttcctggaagcagcattaatgagttagcggtggctacatatgccgtggtgatagctgctgtccagttgcccctccatgggcagaaacctgtgggagggtcagaccagactctttaagtcattcttgaggacaagtagaagggacgtgggcccccccaggatgttcaggtaactggcccatacccggagtcatcctggtgaaagtcaaggggagcaccatgatgtgtgcttcgggacggcggaggatctgccgtgttccctgtggcatgtccagcacctgctcactaccagtgctcaggagaccctcacgagtaagggaatggacaagatgtggtgaagaggagtccctgcaatctgcccttggactgggtgagccaccccagctcgctgagctttactttccttaggtttaccatatccaaagccaactgcagggctgtcaggaggatcagaaatactgtaacagacataatgcaataacatagatgactcttagaggtaaattaaaacagcactttatgcacagtacgatagcatattataaagctcaaaaacaaaatgaaaccatctattgtttagcaatacatgcccaagatacaaccctattaaaaaatcatgggaaggaaaagcacaaaatctgagatggtcgtccctgagaggagtgtgggatgggataaggaaggagcccaggaatttttaaaggtattggtaatatcttagctctcaggtttggtggtaggttcatgggtatttaagttataactcagttcctaactcacataaggtgccacacatccttttgtatgtatcaaatattatgtcataaaattttagtttgggcatggtggttcatgtctgtaatcccagcactttgggaaactgaggcaggcagatcacttgaacccaggagttctagaccagcctgggcaacatgacaaaaccctgtctctacaaaagatacacaaattagctggacatggtggcactcgcctgcagtcccagctactctggaggctaaggtgggaggattgcttgagcctaggagttcaaggctgcagtgagctatgaacttgccactgcactccagcctgggtgacagagtgagaacctgtctcaaaaagaaaaaaaaaaaaaggaaaaaaatttttaaaaaatatttaaaagtaatcaccgaaaaaatagaactcgcttgaaagacaagaccaaaaacgaagaggacgtttccctagatggtgaaaacaagtggggcggaatcactgcagcgtcctgcacagaactctggaattgccactttgcagttgctgccttctagtgtgtattgttgaaagacagttttattgaggcataattggcatacaataagctgcatataaaaatgtgtacgtgatgacttttgacatacgtgtacacccgtgaagctatttccacaatcaagataatcaccatccccttcactctggaaagtttcccatgcccttggtaagcccaccctcctgcttcttgcctcccatccccaagtaacaactgtgctgctttctgtcactacaggttaatctgcactttctagaatgtatgtaaatagaatcacacagtatgtacttgtgttttgtctggcttcttgcttagctgagcataaggatttgcgagtcatccctgttgcatgcattaatattttattcctttttattgccaagtagtattccattgtttggatgcaccagtttggttagctgttcacctgttgatggacatttggaccatgttccgttgtgaactattacaaataaagctgctataaacattcatgta

SEQ ID NO: 155060 - DNA, 2931 bp, Homo sapiens
  Payload ID: 10482
  Gene Symbol: MAP4K2
  Gene Name: mitogen-activated protein kinase kinase kinase kinase 2
  Uniprot ID: Q12851
  ENST ID: ENST00000377350
  CDS Start-End: 93-2531
cagagccacgggcgcccgccccgccccgcgccgccccgcgccggctccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 155061 - DNA, 3169 bp, Homo sapiens
  Payload ID: 10482
  Gene Symbol: MAP4K2
  Gene Name: mitogen-activated protein kinase kinase kinase kinase 2
  ENST ID: ENST00000435926
  CDS Start-End: 14-187
ccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttagtcctctggtccctctgggtagggggagtgaacccacctcatctcccgcctccttccctccaacacacgtttctgtgggcaccacagaagggcagggcccccagggttttggagaagccaggtagaggtgacaggaggccatggcccccagcagccttctaggggcactgtgccttcccctgcatccttgctcagaactgaccctcagctttgcagtttgagggctctgctgtagtttagcaccccaaggactcatgcagatggggggacctcaacaaagggactctcatccagggcacccttgccccacgtaggatct

SEQ ID NO: 155062 - DNA, 1175 bp, Homo sapiens
  Payload ID: 10482
  Gene Symbol: MAP4K2
  Gene Name: mitogen-activated protein kinase kinase kinase kinase 2
  ENST ID: ENST00000424945
  CDS Start-End: 1-434
tctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 155063 - DNA, 947 bp, Homo sapiens
  Payload ID: 10482
  Gene Symbol: MAP4K2
  Gene Name: mitogen-activated protein kinase kinase kinase kinase 2
  ENST ID: ENST00000439069
  CDS Start-End: 27-947
cctgccggcccgcccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactgggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccg

SEQ ID NO: 155064 - DNA, 469 bp, Homo sapiens
  Payload ID: 10482
  Gene Symbol: MAP4K2
  Gene Name: mitogen-activated protein kinase kinase kinase kinase 2
  ENST ID: ENST00000444560
  CDS Start-End: 79-255
cccgccccgccccgcgccgccccgcgccggctccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaag

SEQ ID NO: 155065 - DNA, 2410 bp, Homo sapiens
  Payload ID: 10482
  Gene Symbol: MAP4K2
  Gene Name: mitogen-activated protein kinase kinase kinase kinase 2
  ENST ID: ENST00000433890
  CDS Start-End: 1-174
atggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaa

SEQ ID NO: 155066 - DNA, 4362 bp, Homo sapiens
  Payload ID: 10483
  Gene Symbol: MAP4K3
  Gene Name: mitogen-activated protein kinase kinase kinase kinase 3
  Uniprot ID: Q8IVH8
  ENST ID: ENST00000263881
  CDS Start-End: 326-3010
aaggggagggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttcccgacagtgatggttttttggacagttcagaagaaatatactacactgcaagatctaatctggatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaacatgctgttgtatagta

SEQ ID NO: 155067 - DNA, 4271 bp, Homo sapiens
  Payload ID: 10483
  Gene Symbol: MAP4K3
  Gene Name: mitogen-activated protein kinase kinase kinase kinase 3
  Uniprot ID: Q8IVH8
  ENST ID: ENST00000341681
  CDS Start-End: 315-2936
gaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaa

SEQ ID NO: 155068 - DNA, 558 bp, Homo sapiens
  Payload ID: 10483
  Gene Symbol: MAP4K3
  Gene Name: mitogen-activated protein kinase kinase kinase kinase 3
  ENST ID: ENST00000414968
  CDS Start-End: 1-432
tttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttcccgacagtgatggttttttggacagttcagaagaaatatactacactgcaagatctaatctgtgaactgtatcaattctattgacttcctgctgctttctcatcaggatctgcaactggaatatggacaaggacaccaaggtggttactttttaggtgcaaacaagagtcttctcaagtctgttgaagaag

SEQ ID NO: 155069 - DNA, 689 bp, Homo sapiens
  Payload ID: 10483
  Gene Symbol: MAP4K3
  Gene Name: mitogen-activated protein kinase kinase kinase kinase 3
  ENST ID: ENST00000429397
  CDS Start-End: 161-556
gaggggagcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgt

SEQ ID NO: 155070 - DNA, 500 bp, Homo sapiens
  Payload ID: 10483
  Gene Symbol: MAP4K3
  Gene Name: mitogen-activated protein kinase kinase kinase kinase 3
  ENST ID: ENST00000437968
  CDS Start-End: 242-376
gtgggtgtgaccaggttcggcgcggcggcgggccgcggggggcggggacgattggccgcttgtcgtcgtccgcagcggcgtgaggggagcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactgg

SEQ ID NO: 155071 - DNA, 3924 bp, Homo sapiens
  Payload ID: 10483
  Gene Symbol: MAP4K3
  Gene Name: mitogen-activated protein kinase kinase kinase kinase 3
  ENST ID: ENST00000437545
  CDS Start-End: 152-2584
agttcacatttgtctgctcttccatagtagaatcacccatactctgaatttcttctcagcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaacatgc

SEQ ID NO: 155072 - DNA, 407 bp, Homo sapiens
  Payload ID: 10483
  Gene Symbol: MAP4K3
  Gene Name: mitogen-activated protein kinase kinase kinase kinase 3
  ENST ID: ENST00000484274
  CDS Start-End: 79-357
cgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggtatactgtttgtttcccttttgaaaagcaataatgatttcatcacctaatgcattaaacaaaataaagttagttttaatacca

SEQ ID NO: 155073 - DNA, 7316 bp, Homo sapiens
  Payload ID: 10484
  Gene Symbol: MAP4K4
  Gene Name: mitogen-activated protein kinase kinase kinase kinase 4
  ENST ID: ENST00000350198
  CDS Start-End: 379-3876
gctcactcgctcaactcggcgccgccgcggccccacgctccgggcccgtcctcgaggcgcgcggcgcggggcgcgggcgccggggcctgaggcggcgggcgacgcccgggggcctgacggccggccccgcgccatggtgtgagcgccgccgcccgtgcacgctccgtccgccctccgcgcggcccggccggcagagagccccgagcggcccgagagcgcagccgagcccgccgccgccgcccgcggccccgcgaggagagtaccgggccggctcggctgccgcgcgaggagcgcggtcggcggcctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacct

SEQ ID NO: 155074 - DNA, 6624 bp, Homo sapiens
  Payload ID: 10484
  Gene Symbol: MAP4K4
  Gene Name: mitogen-activated protein kinase kinase kinase kinase 4
  ENST ID: ENST00000302217
  CDS Start-End: 221-3184
cacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacct

SEQ ID NO: 155075 - DNA, 7526 bp, Homo sapiens
  Payload ID: 10484
  Gene Symbol: MAP4K4
  Gene Name: mitogen-activated protein kinase kinase kinase kinase 4
  ENST ID: ENST00000324219
  CDS Start-End: 379-4086
gctcactcgctcaactcggcgccgccgcggccccacgctccgggcccgtcctcgaggcgcgcggcgcggggcgcgggcgccggggcctgaggcggcgggcgacgcccgggggcctgacggccggccccgcgccatggtgtgagcgccgccgcccgtgcacgctccgtccgccctccgcgcggcccggccggcagagagccccgagcggcccgagagcgcagccgagcccgccgccgccgcccgcggccccgcgaggagagtaccgggccggctcggctgccgcgcgaggagcgcggtcggcggcctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacct

SEQ ID NO: 155076 - DNA, 3792 bp, Homo sapiens
  Payload ID: 10484
  Gene Symbol: MAP4K4
  Gene Name: mitogen-activated protein kinase kinase kinase kinase 4
  Uniprot ID: O95819
  ENST ID: ENST00000347699
  CDS Start-End: 1-3720
atggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaact

SEQ ID NO: 155077 - DNA, 7640 bp, Homo sapiens
  Payload ID: 10484
  Gene Symbol: MAP4K4
  Gene Name: mitogen-activated protein kinase kinase kinase kinase 4
  ENST ID: ENST00000350878
  CDS Start-End: 379-4200
gctcactcgctcaactcggcgccgccgcggccccacgctccgggcccgtcctcgaggcgcgcggcgcggggcgcgggcgccggggcctgaggcggcgggcgacgcccgggggcctgacggccggccccgcgccatggtgtgagcgccgccgcccgtgcacgctccgtccgccctccgcgcggcccggccggcagagagccccgagcggcccgagagcgcagccgagcccgccgccgccgcccgcggccccgcgaggagagtaccgggccggctcggctgccgcgcgaggagcgcggtcggcggcctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacct

SEQ ID NO: 155078 - DNA, 3855 bp, Homo sapiens
  Payload ID: 10484
  Gene Symbol: MAP4K4
  Gene Name: mitogen-activated protein kinase kinase kinase kinase 4
  ENST ID: ENST00000456652
  CDS Start-End: 1-3117
atggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttct

SEQ ID NO: 155079 - DNA, 6958 bp, Homo sapiens
  Payload ID: 10484
  Gene Symbol: MAP4K4
  Gene Name: mitogen-activated protein kinase kinase kinase kinase 4
  ENST ID: ENST00000413150
  CDS Start-End: 56-3520
cacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacac

SEQ ID NO: 155080 - DNA, 4403 bp, Homo sapiens
  Payload ID: 10484
  Gene Symbol: MAP4K4
  Gene Name: mitogen-activated protein kinase kinase kinase kinase 4
  ENST ID: ENST00000425019
  CDS Start-End: 338-4156
gggcccgtcctcgaggcgcgcggcgcggggcgcgggcgccggggcctgaggcggcgggcgacgcccgggggcctgacggccggccccgcgccatggtgtgagcgccgccgcccgtgcacgctccgtccgccctccgcgcggcccggccggcagagagccccgagcggcccgagagcgcagccgagcccgccgccgccgcccgcggccccgcgaggagagtaccgggccggctcggctgccgcgcgaggagcgcggtcggcggcctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattcta

SEQ ID NO: 155081 - DNA, 3416 bp, Homo sapiens
  Payload ID: 10484
  Gene Symbol: MAP4K4
  Gene Name: mitogen-activated protein kinase kinase kinase kinase 4
  ENST ID: ENST00000421882
  CDS Start-End: 1-3169
gttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattcta

SEQ ID NO: 155082 - DNA, 526 bp, Homo sapiens
  Payload ID: 10484
  Gene Symbol: MAP4K4
  Gene Name: mitogen-activated protein kinase kinase kinase kinase 4
  ENST ID: ENST00000427603
  CDS Start-End: 221-526
aaacacagtgctcacctaccgagcgcagccaggagcgcagcgccagacaattacaggagctgttttggatatggccgggcagcccagcgatgctcagcgaatcccacaactacaaccacaaccgtaccacacatttagcctgcaaaagcagagaaaggaaaagaaaaccgtgcagggaagccggaaacgagggacttaagggtctcctctctaggggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctgg

SEQ ID NO: 155083 - DNA, 4251 bp, Homo sapiens
  Payload ID: 10484
  Gene Symbol: MAP4K4
  Gene Name: mitogen-activated protein kinase kinase kinase kinase 4
  ENST ID: ENST00000417294
  CDS Start-End: 1-3513
gtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttct

SEQ ID NO: 155084 - DNA, 776 bp, Homo sapiens
  Payload ID: 10484
  Gene Symbol: MAP4K4
  Gene Name: mitogen-activated protein kinase kinase kinase kinase 4
  ENST ID: ENST00000418101
  CDS Start-End: 1-776
caacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagca

SEQ ID NO: 155085 - DNA, 7458 bp, Homo sapiens
  Payload ID: 10484
  Gene Symbol: MAP4K4
  Gene Name: mitogen-activated protein kinase kinase kinase kinase 4
  ENST ID: ENST00000625522
  CDS Start-End: 56-4018
cacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacct

SEQ ID NO: 155086 - DNA, 3135 bp, Homo sapiens
  Payload ID: 10484
  Gene Symbol: MAP4K4
  Gene Name: mitogen-activated protein kinase kinase kinase kinase 4
  ENST ID: ENST00000627726
  CDS Start-End: 1-3135
atggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgtgcaggatcagaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 155087 - DNA, 3800 bp, Homo sapiens
  Payload ID: 10484
  Gene Symbol: MAP4K4
  Gene Name: mitogen-activated protein kinase kinase kinase kinase 4
  ENST ID: ENST00000634702
  CDS Start-End: 56-3553
cacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattcta

SEQ ID NO: 155088 - DNA, 4354 bp, Homo sapiens
  Payload ID: 10485
  Gene Symbol: MAP4K5
  Gene Name: mitogen-activated protein kinase kinase kinase kinase 5
  ENST ID: ENST00000013125
  CDS Start-End: 320-2860
gggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaagtaggtcccgggctccgcgctcaacaaagacggggccgcccccattagacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagtaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaat

SEQ ID NO: 155089 - DNA, 484 bp, Homo sapiens
  Payload ID: 10485
  Gene Symbol: MAP4K5
  Gene Name: mitogen-activated protein kinase kinase kinase kinase 5
  ENST ID: ENST00000554273
  CDS Start-End: 318-484
gccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaaacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctgg

SEQ ID NO: 155090 - DNA, 619 bp, Homo sapiens
  Payload ID: 10485
  Gene Symbol: MAP4K5
  Gene Name: mitogen-activated protein kinase kinase kinase kinase 5
  ENST ID: ENST00000554091
  CDS Start-End: 39-227
cgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctgggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaa

SEQ ID NO: 155091 - DNA, 545 bp, Homo sapiens
  Payload ID: 10485
  Gene Symbol: MAP4K5
  Gene Name: mitogen-activated protein kinase kinase kinase kinase 5
  ENST ID: ENST00000557390
  CDS Start-End: 135-545
ggaggacgcgggtgcggtctaggaaacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatg

SEQ ID NO: 155092 - DNA, 592 bp, Homo sapiens
  Payload ID: 10485
  Gene Symbol: MAP4K5
  Gene Name: mitogen-activated protein kinase kinase kinase kinase 5
  ENST ID: ENST00000555216
  CDS Start-End: 267-592
actcgcggtgtgaacatactgggtctcgcctctcctttcccctcccctcggcctggtgctgaatcatgagcccaatgtctccaaaagatcatctcaggccacctcagtgtatactcttccatttgacaacggaattctgctgcccatgttcaacttacgatccagtaaattaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcat

SEQ ID NO: 155093 - DNA, 4005 bp, Homo sapiens
  Payload ID: 10486
  Gene Symbol:
  Gene Name: Mitogen-activated protein kinase kinase kinase MLK4  [Source:UniProtKB/Swiss-Prot
  Acc:Q5TCX8]
  ENST ID: ENST00000366622
  CDS Start-End: 121-1569
taattttctcattgttttcatgttttgagtaaggtagtttcacaactgatatgattcatttagcttttttaacaaagccaatattggttaatatgattgttgtggttaatatggttaataatgttctttttagtgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtgtaaaacaagagatgtgcaccaatgaaaactatgctgggtcgaattaccttcagcacaatgttaatgtttttgttctcatttatgcctttgtccatttgcacacaacagaaattgtaatgagcttcactatttttgtttctttccttccttttttttcttttttcctttctttcctttttcttgtcttgtttcttgtttttttttcttgtagtttcttttcttaattgtcatttttgcaacaaaaagccaagaaagagctttagtttcttggcaagaataatgtgatattagtaagtaaaggtcttaaaagtctgacgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagt

SEQ ID NO: 155094 - DNA, 3910 bp, Homo sapiens
  Payload ID: 10486
  Gene Symbol:
  Gene Name: Mitogen-activated protein kinase kinase kinase MLK4  [Source:UniProtKB/Swiss-Prot
  Acc:Q5TCX8]
  ENST ID: ENST00000366623
  CDS Start-End: 262-1974
cagggcctgggcacgaccatggtgggacgtcgcccgcggcttcggggaccgctgcggcagcagaggcggctggccaggaacgcgggccgaggctggaccctttgggcagctagcccgtgatctctgccgtcaccgatcgcgattcctaccccctcgccttcccccggcgccgacggccacaccgccggacgatgcgcgcccgcggccgcccgggaggctgagcccagcttcccgctccgccttccccgcgcagctgcccccatggctttgcggggcgccgcgggagcgaccgacaccccggtgtcctcggccgggggagcccccggcggctcagcgtcctcgtcgtccacctcctcgggcggctcggcctcggcgggcgcggggctgtgggccgcgctctatgactacgaggctcgcggcgaggacgagctgagcctgcggcgcggccagctggtggaggtgctgtcgcaggacgccgccgtgtcgggcgacgagggctggtgggcaggccaggtgcagcggcgcctcggcatcttccccgccaactacgtggctccctgccgcccggccgccagccccgcgccgccgccctcgcggcccagctccccggtacacgtcgccttcgagcggctggagctgaaggagctcatcggcgctgggggcttcgggcaggtgtaccgcgccacctggcagggccaggaggtggccgtgaaggcggcgcgccaggacccggagcaggacgcggcggcggctgccgagagcgtgcggcgcgaggctcggctcttcgccatgctgcggcaccccaacatcatcgagctgcgcggcgtgtgcctgcagcagccgcacctctgcctggtgctggagttcgcccgcggcggagcgctcaaccgagcgctggccgctgccaacgccgccccggacccgcgcgcgcccggcccccgccgcgcgcgccgcatccctccgcacgtgctggtcaactgggccgtgcagatagcgcggggcatgctctacctgcatgaggaggccttcgtgcccatcctgcaccgggacctcaagtccagcaacattttgctacttgagaagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggagctatggagtgctgctgtgggaactgctcaccggagaagtcccctatcggggcattgatggcctcgccgtggcttatggggtagcagtcaataaactcactttgcccattccatccacctgccctgagccgtttgccaagctcatgaaagaatgctggcaacaagaccctcatattcgtccatcgtttgccttaattctcgaacagttgactgctattgaaggggcagtgatgactgagatgcctcaagaatcttttcattccatgcaagatgactggaaactagaaattcaacaaatgtttgatgagttgagaacaaaggaaaaggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagtgtgagctttctgcactgccacgggggctcctgtgttgacttctctcctttcacttgacttggattcaaattgagcagatgtgttttcatagcaggttgtagatgagtgtaggacatttcgtaggtgccacaactatttgagaaacaaaacttgagcataggttccttagtctaattttcttctactcacaaaaaatgaattttagatgctatgcagttggtgatgcgacctggccccggagtagaaagtgaaacaccacatctcgagacattctgttaaacacttgcacgcaacgttagcataacctaattctatcatcagccatttgtgtcagggtactttgaaaaatgaaatcaggaattcaggattacttctgtttctttctttgtttcgtgaggggaaaaaatttttgcttttcaggatttaactttaattcactttaggtttgaccaacctaatacttaaaaattccttgtagtgttttggttttagaacaagcattcatcctggaggagacagtacagacagctgattcgcctggcacctttgcattgtgagagtttcagttaggctatgaatcagaatgtagcggatgaaataaaattactaatttttttcaaaggtgagtccagataaacccctaaaagtaggctaagcgaaagaagaatgtgattaatgcgtatgtctgtaagtaatgtggtaattagcctaagtctgtggtaaaccattcatttggatcctctccttcctccaccaaacttaattccctgctgtttactcatccttatttggagaaaaaaaaaatccaaaagaaaattttgtctaatgaggcttgcatggaatctcatttttttttcctcttttgataatgaaaaccttggcaccagcagagatttcttttgcaagttctcggacaccaggatccccacagagaaactggatctaaatgaggctgtagttttagagcttaaaggactgtcatttattataactgatttggttttctgagaatgcattttgcataaaaccgtacctcaaaccttgcctttgcctaggcaaaggcctaattaacggagagagaaagggtcccaggctggtctcccagctccacgaagggatgagcagatgggacaccgtgccacccctgcttttgcctggccactcctctgccctctttcctgtgtcttcaccttctgctctggggaaaaccacctcacagaagccaggaagtggtactgggaaggcctggctgggcccaagatgtgtaccagttaaagtaaataatttgggacttcaaatgaattccaaccctccaaagttgaaatgcagccagcttagggaggcgcatccttggcgctccttctcagaagtaacatggtggaaaggttctaatcgagacagtccacacagggccagctttgtgtgtggcagctgttggctcaagttctccagcctggatgttgctcatcttcattgtgaccctgggtgctccaagaatgcctcttgtcttcatgtgtgtgcacacccccattcaattctgacagcctcattgagtggacccttttatgatccccaaatgcgggacagagaagttaccattaagctgacccaagttggtagctactaactggtgaagctggattcagacacatctgagtgtagatttcaccatccgtttccggcctcttagtacaggaaaagttcaatcaatgtggaaacaaaagagaaaccagaggagcaaatcaagaggggaaggaaagtaggaagggacgaaggtgaggagactaaagccgagagtgtagatagctctgggagtgtagatcagtcagtcagtcatatagccgagatgaacttgggtctaataacccccagctgaaagcttttccggttctgctgccctcacttaaatgaaaactgctgatccgtttatctgtcattctactgtaaaactcttttaataaaaagaatgaacag

SEQ ID NO: 155095 - DNA, 5809 bp, Homo sapiens
  Payload ID: 10486
  Gene Symbol:
  Gene Name: Mitogen-activated protein kinase kinase kinase MLK4  [Source:UniProtKB/Swiss-Prot
  Acc:Q5TCX8]
  Uniprot ID: Q5TCX8
  ENST ID: ENST00000366624
  CDS Start-End: 262-3372
cagggcctgggcacgaccatggtgggacgtcgcccgcggcttcggggaccgctgcggcagcagaggcggctggccaggaacgcgggccgaggctggaccctttgggcagctagcccgtgatctctgccgtcaccgatcgcgattcctaccccctcgccttcccccggcgccgacggccacaccgccggacgatgcgcgcccgcggccgcccgggaggctgagcccagcttcccgctccgccttccccgcgcagctgcccccatggctttgcggggcgccgcgggagcgaccgacaccccggtgtcctcggccgggggagcccccggcggctcagcgtcctcgtcgtccacctcctcgggcggctcggcctcggcgggcgcggggctgtgggccgcgctctatgactacgaggctcgcggcgaggacgagctgagcctgcggcgcggccagctggtggaggtgctgtcgcaggacgccgccgtgtcgggcgacgagggctggtgggcaggccaggtgcagcggcgcctcggcatcttccccgccaactacgtggctccctgccgcccggccgccagccccgcgccgccgccctcgcggcccagctccccggtacacgtcgccttcgagcggctggagctgaaggagctcatcggcgctgggggcttcgggcaggtgtaccgcgccacctggcagggccaggaggtggccgtgaaggcggcgcgccaggacccggagcaggacgcggcggcggctgccgagagcgtgcggcgcgaggctcggctcttcgccatgctgcggcaccccaacatcatcgagctgcgcggcgtgtgcctgcagcagccgcacctctgcctggtgctggagttcgcccgcggcggagcgctcaaccgagcgctggccgctgccaacgccgccccggacccgcgcgcgcccggcccccgccgcgcgcgccgcatccctccgcacgtgctggtcaactgggccgtgcagatagcgcggggcatgctctacctgcatgaggaggccttcgtgcccatcctgcaccgggacctcaagtccagcaacattttgctacttgagaagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggagctatggagtgctgctgtgggaactgctcaccggagaagtcccctatcggggcattgatggcctcgccgtggcttatggggtagcagtcaataaactcactttgcccattccatccacctgccctgagccgtttgccaagctcatgaaagaatgctggcaacaagaccctcatattcgtccatcgtttgccttaattctcgaacagttgactgctattgaaggggcagtgatgactgagatgcctcaagaatcttttcattccatgcaagatgactggaaactagaaattcaacaaatgtttgatgagttgagaacaaaggaaaaggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagttgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtgtaaaacaagagatgtgcaccaatgaaaactatgctgggtcgaattaccttcagcacaatgttaatgtttttgttctcatttatgcctttgtccatttgcacacaacagaaattgtaatgagcttcactatttttgtttctttccttccttttttttcttttttcctttctttcctttttcttgtcttgtttcttgtttttttttcttgtagtttcttttcttaattgtcatttttgcaacaaaaagccaagaaagagctttagtttcttggcaagaataatgtgatattagtaagtaaaggtcttaaaagtctgacgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagta

SEQ ID NO: 155096 - DNA, 7179 bp, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  ENST ID: ENST00000338983
  CDS Start-End: 196-1563
cttcctcattggcgccgtgcagagaggcggaatgttcaactcctaactgcagcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtctcaaaaaacaaaaaaaagaaagaattgatagtacaaaatccaacaacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtatgtgtggtggtttgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttatgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctccctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaacaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttattgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaa

SEQ ID NO: 155097 - DNA, 3741 bp, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  Uniprot ID: Q9NYL2
  ENST ID: ENST00000375213
  CDS Start-End: 79-2481
cctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccattcgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaatat

SEQ ID NO: 155098 - DNA, 2572 bp, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  Uniprot ID: Q9NYL2
  ENST ID: ENST00000409176
  CDS Start-End: 137-2539
ggtgccccccgggcgcaggccagggaggcccgagcgccttccccacgccccgctcgcccgcgcgtgtgaggggagggcggcccagccgtttcgcgccgggagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccattcgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggtt

SEQ ID NO: 155099 - DNA, 661 bp, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  ENST ID: ENST00000422149
  CDS Start-End: 247-661
atgcaagcttgctgtggaaagcatgcttcccgtctgtcagggcttcctgagaggagacctggtgacacagtagcctttcggcagagctccttgggatgagtaggaagtgctgctgcaggttttgtctgggggatatctgagccatttctctgtgggcagctgtgtttcaaagtctgggcaggttgttgttgaattttgcgtgggctgccaggattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacg

SEQ ID NO: 155100 - DNA, 2312 bp, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  ENST ID: ENST00000539448
  CDS Start-End: 271-1638
agagaggcagccttcagacctatgttcccagaaatctctacgtttgtgcctttcccaactagagaattaactcttgcggggcacaaaacagcctctatttctttgcgtccccagcgcctgtttgttgaagactgagttgaaggagtagcaggtggtgttaatttgtcaaaaagatgagttaaggtgctgggggcgagggggaacacccccacggccctccccccacagcaaggcagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtct

SEQ ID NO: 155101 - DNA, 2171 bp, Homo sapiens
  Payload ID: 10488
  Gene Symbol: MAPKAPK2
  Gene Name: mitogen-activated protein kinase-activated protein kinase 2
  Uniprot ID: P49137
  ENST ID: ENST00000294981
  CDS Start-End: 287-1399
gcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccgggtcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattc

SEQ ID NO: 155102 - DNA, 2961 bp, Homo sapiens
  Payload ID: 10488
  Gene Symbol: MAPKAPK2
  Gene Name: mitogen-activated protein kinase-activated protein kinase 2
  Uniprot ID: P49137
  ENST ID: ENST00000367103
  CDS Start-End: 194-1396
gagccagcggcgcgcggtgggacccacggagccccgcgacccgccgagcctggagccgggccgggtcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccaggggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttga

SEQ ID NO: 155103 - DNA, 2500 bp, Homo sapiens
  Payload ID: 10489
  Gene Symbol: MAPKAPK3
  Gene Name: mitogen-activated protein kinase-activated protein kinase 3
  Uniprot ID: Q16644
  ENST ID: ENST00000357955
  CDS Start-End: 110-1258
ctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 155104 - DNA, 873 bp, Homo sapiens
  Payload ID: 10489
  Gene Symbol: MAPKAPK3
  Gene Name: mitogen-activated protein kinase-activated protein kinase 3
  ENST ID: ENST00000451680
  CDS Start-End: 1-292
cctgggccagtacggcttccccaatcctgagtggtcagaagtctctgaggatgccaagcagctgatccgcctcctgttgaagacagaccccacagagaggctgaccatcactcagttcatgaaccacccctggatcaacgaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctgga

SEQ ID NO: 155105 - DNA, 2988 bp, Homo sapiens
  Payload ID: 10489
  Gene Symbol: MAPKAPK3
  Gene Name: mitogen-activated protein kinase-activated protein kinase 3
  Uniprot ID: Q16644
  ENST ID: ENST00000446044
  CDS Start-End: 597-1745
gggctgagcggtggggcccgggcggggtgcgcgggccccgtcgccgggtctggggccctgagcagtgaaaggaaatactttgacagatttccaagaactttccaggaaaacggggcggggccccgcgagctgaccaatcgcgacgctgaaggtggagccgagcggtcggggagggccaatagcagcgcgtggacccggggctgaagctacccagaggggcagggagtacttgctgcatttgatcctctacaactggtgttgctcccgttatgcggacagaagacagccccagggaacaaatgctaggaaatggcagggtgagaaaactgaggcatggagaggttacaatataacttagatctcccagctggcaagtaatggtttaagccaggagcctacacacttcctcctacttcctctatgggtgctggtgatctgccgactcctagacatccagctttaaggtcctcagtgaagcttctctgcccccaggcctgtccatgtcagagcaccatgggtgtccctttgaaagtatctcctacaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattt

SEQ ID NO: 155106 - DNA, 535 bp, Homo sapiens
  Payload ID: 10489
  Gene Symbol: MAPKAPK3
  Gene Name: mitogen-activated protein kinase-activated protein kinase 3
  ENST ID: ENST00000457064
  CDS Start-End: 177-535
ctcaggccgttcgtcccgcactcccagcttgccccgggctcgcagcccagcccagttcagaggctccaaggctggggtgtgttggaaaagtctgggcgggactcactcttcccctttcccccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatg

SEQ ID NO: 155107 - DNA, 1160 bp, Homo sapiens
  Payload ID: 10489
  Gene Symbol: MAPKAPK3
  Gene Name: mitogen-activated protein kinase-activated protein kinase 3
  ENST ID: ENST00000430409
  CDS Start-End: 164-1160
acgtgggcgccggcagcgcgactctcggccctgggatttctgcggccgccagctcccgcgaccgcctctcctgcccctcgccggtacctcagcaaggtgcgttgccgccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaagg

SEQ ID NO: 155108 - DNA, 2563 bp, Homo sapiens
  Payload ID: 10489
  Gene Symbol: MAPKAPK3
  Gene Name: mitogen-activated protein kinase-activated protein kinase 3
  Uniprot ID: Q16644
  ENST ID: ENST00000621469
  CDS Start-End: 164-1312
acgtgggcgccggcagcgcgactctcggccctgggatttctgcggccgccagctcccgcgaccgcctctcctgcccctcgccggtacctcagcaaggtgcgttgccgccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattttctcttgg

SEQ ID NO: 155109 - DNA, 875 bp, Homo sapiens
  Payload ID: 10490
  Gene Symbol: MAPKAPK5
  Gene Name: mitogen-activated protein kinase-activated protein kinase 5
  ENST ID: ENST00000553053
  CDS Start-End: 252-476
gtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagtcctctccatgatctgtgtcaaactgctttgggcctttatgaagtggcctgtgctgtactgtagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaaca

SEQ ID NO: 155110 - DNA, 1630 bp, Homo sapiens
  Payload ID: 10490
  Gene Symbol: MAPKAPK5
  Gene Name: mitogen-activated protein kinase-activated protein kinase 5
  Uniprot ID: Q8IW41
  ENST ID: ENST00000551404
  CDS Start-End: 109-1530
ccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggtaaaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccaca

SEQ ID NO: 155111 - DNA, 11349 bp, Homo sapiens
  Payload ID: 10490
  Gene Symbol: MAPKAPK5
  Gene Name: mitogen-activated protein kinase-activated protein kinase 5
  Uniprot ID: Q8IW41
  ENST ID: ENST00000550735
  CDS Start-End: 757-2172
attagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatcaaggactctggattctggtttcaattgccctgtgtgtttattttccacaccattgctagattagctctactgccaagacatttttgtggctgtcattgcagactgcttgctggaactcacaggaggcacacttgagcttggggagccaacttccatgatggaagaagagggaggtgagccctcatttctcctgccccctaattcccaagagaaaagcaggaacatttcctttttgtcatatctgttaaaagggtactggtgtgtttcttaaatctaacagggttttcttttgggtttattctttttttttttttttttttgagacagagtcttgctgttgtagtggaggctggagtacagtggcactatctccgctcactgcaacctccgcctcccaggttccagtgatcctcccacatcagcctcccaagtagctgggattacaggtgcccgccaccacgcctggctaatttttgtatttttagtagagacagggtttcaccacgttggccaggctggtcttgaactcctgacctcaggtgatacgtctgccttggcctcccaaagtgctgggattacaggcgtgagccactgtgcccggccttgggtttattctttctttatatgtttgtttgtttgtttgttttgagatggagtcttgctcttatcacccagggtggagtgcagtggcacgatctcggctcactgcaacctctgtctcccaggttcaagtgattctcctgcctcagcctcccaagtagttgggattacaggcacccgccaccatgcccggctaatttttgtatttttagtagagacagggtttcaccatgttggccaggctggtctcgaactcctgaccatccacctcagcctctcaaagtactgggattacaggcatgagccaccaagcctggcctattctttatatgtttaaccggagcttccctttccccttccaggaggtcctgctttgtcctttccccttccctgcagccttcaccagctccattactccttatttctgttccctgttcctctggtcctgtttttggaataacttgtccgagaaatttacatataattaattgaagtgggactattggattatcatgtaagatgatccagttttggtttttttttttataaggctgccctgtttctctgtaatatgtctgtctgggttttgtgttggcatcctctgggctgcatttatcttgtttattacccttcattttcaggaagcatggttttggccccgagagcagctgtttgaaggaaaaataaggctaggtccttttttagttttctgttgtgagtatgggtttccataacaaaccaattttcgtgtatatgtgtgtgtgtgtgtgtgtgtgtgtgaagcagtttttggtgggtacttacgttggtacatagaaaagctggcaggtagactccagctcgcagagcagagggagaggatagtcatctgttattcaattttttctcatctcattctcttcgatcaaaattgatctcaccagcaacttattttctaactcctccactgtgctgagtaattcctccaccctgaatcttcagggtgacatttggttagtatgccctgtatgtgtgtgactgcctgtgggaatagatgataaaaaacaagtgtcttaagaattaccttattacattgcttccttttttttttttttttttttttgagatggattcttgctctgtcgcccaggctggagtgcagtggcgcgatcttggctcactgcaagctctgcctcccaggttcacaccattctcctacctcagcctcctgagtagctgggactatacaggtgcccgccaccgcgcccggctaatttctttttgtatttttagtagagacagggtttcaccgtgttagccaggatggtcttgatctcctgacctcgtgatccgcccacctcagcctccaaaagtgctgggattacaggtgtgagccactgcacccagcctacattggttcctttttatcttggagaatttaattgaaagatattttttgagataaagttcactaatcttaggtgactgataactgttataaatggatttcctgtaaggagaatatgtctcccccccaccccccaccctgctgccaccaagacagagtctcgctctgtcccccaggctggagtgcagtggcttgctcttggctcactgcaacctctgcctcccaggttcaagcgattctcgtgcctcagacttccaagtagctgggactacaggcacacaccaccacgcccagctaatttttgtgtttttagtagagacggggtttcatcatattggccaggctggtctcaaactcctgacctcgtgatccgcccacctcggcctcccaaagtgctgggattacaggcgtgagccaccgtgcgcgacctgaatacttttcatgatggcaaaatctcaccggcaacagaagaaaaaccaatgtttttaaatttactgaccagaaaacttgactgagagttgaattaagtgcctgttgttgtgtttttcagtgaaatgcaaatcttacagatcacttcttacagttaggaatactgcacttgtttgtgtaatattagaacaactgtagttttcctatcttagggcagaggttcagtattccatggggagaaaaaaacagtaattatctttgttactcttcttctttagaggaatattctagcatatccattatatccataacttcttaaatttgtgacttgggtgtcttctaaaaaggctcaggatgattattttttccttcagtgtatgctgaattttaggtgcgatggaaaaggtatccaaagtgatactccctttgactctgagcatcagttgcccgtgtttcagtcacttcaagctgaattcatgccctcaatgtaagtgctgtgtccagacacatccaaatgagcaccaagctggaagtttgtgaacactctggaggatgccccagctgttgtaatgcaacagcataccttgaaaaaaaacagtagctcccaagggactcagcatggcttggtcttcgaagtggagttttgtttgtgtattcctagtccagcagtaaattctgctttaacataactgtcaggtttgctactcgaaatttgcacataactggaagtgaaacgatatctttctcatattttttggcctaacaaacacctatacctgtggaaacataacactgtaaatataattcttataaagcagcaggttatgctctcctgtttgcctacatgatttattaaccttctgcttactaaagccattactggtcaatcagatacttttagactttaccacagttataaaagtcagcttgatgtagtaaaaaaacttgtctctctctgactaatatgtatgaatataggagaatcccagtctgaatttactgtttgaaacatagatgaggctcagcgtggtggctcatgcctttagtaatcccagcactttgggaagctgaggcgggcagatcaccttaggtcaagagttcaagaccagcttggccaacatggtgaaatgccgtctctactaaaaatacaaaaattagccaggcatggtggcacatgcctgtaatcccagctgctcgggaggctgaggcaggagaattgcttgaacctgggaggcagaggttgcagtgagtggagatcgcaccattgcactccagcctgggtgacagagcaaaactccgtctcagaaataaaaaagagacgtgatcctgctatgttgcccaagttagactcaagctcctgggctcaagcaatcctcctgcctcagccttctaagtagctgggactacaggagcaaaccactgtgcctggcaggaattactctttaaaaagagtttatgttgcttgtattcatttgagaaaaaatgagttgaagaaatggtaattgttggtcaaagaagccaaaagatttaaataaggtcttgtgtgtgggtatgtgtatgtgcatgtatttattgaagaaaataagtttcaatttgagaattagaaaattggatatttcattttaattatttatttaaagagtagagtgttcttccattattgaatcttcttttatcccaccaaatggcttaacctaatttgcgctgcctattttggttaagaaacagggaaacaccctaaaatctgtgataattttcaaaatacaattttaagaagctttgcgcttacataaatcacaagaaatacagctggaaatcatttcacttttcttgctgtaaatttttttagtgggtttgtgacagtataaattttcttgctagatgctaatgatacattgtattatctgtattaggaattaaatatttaataggaatagtgaataaattgatctgctctcatgctgttatctaagatcttatgctaccattacattcctttctgtagtcgtatctcatatttgaaaggtctcatgttgtaaatatttgacttgctgtaaaattatacaagataaaaaatgtagagttttatttttcttcatctagaatgcacagaataactgcgtaaggaatgggtgcatagggcttcttttccttttaaatttgtactgctaaatacaccaaggaaattgacatcaaaaccaaattcaaggacttccacagacatttcaggtcaattttagttccaaaccgaagaaatcttttaaaagttcttatatagcccagttttcttttcttgatgaaatgttaactagacacctggttagtcagcttttattttgaccccacagttttttttttgagacggattctcactctgttgcccaggttggagtgcaatggtgtgatctcggcttactgcaacctacgcctcctgggttcaagcgattctcctgcctcaccttcctgagtagctgagattacaggcgcctgccaccacgccccgctaatttttgcatttttagtagggacagggtttcaccatgctggccaggctggtctcgaactcccgacctcaggtgatccgcctgcctcggcctcccaaagtgctgggattacaggggtgagccaccgtgcccgggccccacactttgtttttatgttagggcagttggaggaactgaactttgatcctgatcctttatatactcccatggtgaaacttgagcccattttacttaacacaatatatccgtgcattaggaaaacttggtagagaagattatatgcagatataaaatatctaaactcatttgttatgaaccaacgataatgagggaaaacttggacatccacatacagattttcttgaattaaagaaaaaaaccagacactgacaaaggagagctgaactgataaatggtaccctgaaaactgcagaaatgagggaaagaggcagtgggccacaaagaactttgtccttttcagagatccccagagaagccctgcccccttccccccaccccctgacagaatgttgtgtttcaaagaatgagcagattaatggatatcaagttgtgtggcctgagctgaggataaagaataatttgcctgaggagttacagtactggctggatcactacaggccttctacttggaatatcttcccatgaaagtaaaaggaatataactaaggaagattaaagttgttgctgttggaaggaagacatactaaagaaactgccgaaggccaggagagaagcaggaagagaaacacggcttgaagttctgtaagaatcagagttgggcaagaactgccaataagggagccagcgtagatctgagtactaaacacctgagcctccgagggtttgtgtgcgagggagagctctgctgatggacataggcccagaatcattaactgatttatttgggccatgtcactggtggcattattaaaagactctgccaacatcctgctttatggaaaaaccaagtggccttggaagaggctaagataaagtttcaaacttgggctccacagaagtggaacttaaggctggggctagtaccaggaccttcatgtatcaggttagagattttgatgcttttggtgatttttgtgccaagcatgtactgtcacctgggatcaatctattactctttctatgaaataattattccaaagaggctgacagtccagggaggagatagcccagtggaaggactgtcctacttgttacttatgcaaggccagaagcacctggttcatctgaaggtgaagagaaaccattttgtgaataactttccagtctacagttaccacaatggcctcctggggcaagaatcgcctttcatctcacatgactgccactatgaaggctacatagaaggagtgtcaggttcttttgtttctgtcaacatctgtgcaggtctcaggggcacatcctcctgattaaggaggaaaaatcttacagcattgagcccatggactcttcaagacggtttgaacatgtgttatacaccatggcacatcaagcgtgagtctcctgtggtgtctactagctggcaacaagggagcaggaagcctcatgatctacaggcactgtcctacttgtggtcacacaaaaagtacgtggagatgtttgtcgtggtcaacaaccagcggttccagatgtggggcagtaacgtcaatgagacggtccagacagtagtggatgtcattgctctggccaacagcttcactaggggaataaacacagaggtggtgctggctggaatggagatttggaccgagggggacctaatagatgtcacagtggacttgcaaatcacactcaggaatttcaatcactggagacaagagatgctcttccatcgtgcaaaacacgatgttgcccacatgatcgttgggcatcaccctggacagaatatgggccaggcctttctcagtggtgcctgctcaagcggttttgcggcagctgttgaatccttccatcatgaagatgtgctgttgtttgcagccctgatggcccatgagctcgggcacaacctgggtattcagcacgaccactcggcctgcttttgtaaagataagcacttttgcctcatgcatgaaaatatcacaaaagaaagtggcttcagcagctgcagctctgactacttctaccagttccttcgagaacacaaaggggcctgcctatttaacaagccacggcccaggggccgcaagcgtagggattctgcctgtggaaatggtgtggtggaggacacggagcagtgtgactgtggttctctatgtcagcatcatgcatgctgtgatgaaaactgtatactgaaggcgaaagcagagtgcagtgatggtccatgttgtcataagtgtaaatttcaccgtaagggatatccttgctgtccttctagtcgttcctgtgatctcccagaattttgcaatggtacatctgcattatgccccaacaacaggcataagcaagatggctcaaaatgtcatacaatttacgagtgccttaaagttcattgtatggaccctaataatcagtgcttacaattatatggatatggtgcaaaatcagcctcacaagagtgttacaattcaatgaacagcaaaggggaccaatttggaaactgtggcatttctaccagtcctgggtcacaatatgttcggtgttcagatggtaatatattttgtgggaaacttatatgttcaggtattacaggcttaccaaaaatcaatctccaacatacaatgattcaggtccctcagggagatggctcatgttggagcatggatgcctatatgagtactgacattcctgatgaaggagatgtgcacaatggcacttactgtgcaccaaacaaagtctgcctgaattccgcctgcacagataaaaccccagtgatttctgcctgcaacccagaaaaaacgtgtaatgggaagggagtttgtaatgatttagggcactgccactgtaatgaagggcatgccccccctgactgtgttactgcaggaagtggaggtagtgtggacagtggccctcctggtaagctaggtgggacaccttcaggagaaggtgaaaatcacaatatgactcattccagacgtgaagaacatgctgtagacatgatgatattatcattcattatactttttataatattattattaagtacaattatttgatctgcttgcttaaaaaatcaccagaggctgccccggcagaagctcctccagcagtggctccaccaccggccccagaaataaagccagaagcagcagaagtggccacagaagaaaaagaagagaaggaggaagaaaaagaagaggaggaggaggaagaagaggaggaagaatcagattcctaaggttagaaatagggagatgaagccaagtatatcaaactcctcaagtactgagtgggaatgagatgtttggtgaagtagaaatagatagctttagtggctctgactcagatatactgatgtagaaggaaggattctttcacttttattatttattttggtaattaaatttacattaatttaatatgttaaatattttagtaccttttgctttttcacatttcatttgaaccattaacatgcatctttggacatcaatgtccttgtctttttggcccaattgttttagtcaccagaaactttttcaggacatgctatcttctatttgtttgacatacagaatcatatgtacctgaatttattactaactctgggattttcattttaagtaacaactacctattatgtgaggacagttgtttatgtgattggttgttctaacttgccctataaatgtgcattcatcaaaggagaagtttttaaatccaaaaacaaataaaacccgattcatattagacaactcttcaggttccaca

SEQ ID NO: 155112 - DNA, 974 bp, Homo sapiens
  Payload ID: 10490
  Gene Symbol: MAPKAPK5
  Gene Name: mitogen-activated protein kinase-activated protein kinase 5
  ENST ID: ENST00000549875
  CDS Start-End: 1-974
atgtcggaggagagcgacatggacaaagccatcaaggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggtaaaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaata

SEQ ID NO: 155113 - DNA, 494 bp, Homo sapiens
  Payload ID: 10490
  Gene Symbol: MAPKAPK5
  Gene Name: mitogen-activated protein kinase-activated protein kinase 5
  ENST ID: ENST00000547305
  CDS Start-End: 260-415
gcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggccgccagcatttgcttccggatggtctacagaacttggagagttggaatttatccatccctcccgatttgtttgaaatcagccttctggaaatctgcagttggaaaaaggaagcattgagtttacttaggaaaagttaacagttcctgtgacttaactgcacttaaaccaaaagaaaagcaaatgtgtgttcgaaaat

SEQ ID NO: 155114 - DNA, 2299 bp, Homo sapiens
  Payload ID: 10491
  Gene Symbol: MZT1
  Gene Name: mitotic spindle organizing protein 1
  Uniprot ID: Q08AG7
  ENST ID: ENST00000377818
  CDS Start-End: 86-334
gagacgcgctgtgtgattgcctcggagagaggaaggcgctccagttccgggtcaggcccttctcccgcctccctcggccttagccatggcgagtagcagcggtgctggggcggcggcggcggccgcggcggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgttttgtttgtcattattcttgcctttaaaattttaactcatcaaagtgaagattagaaataaattttagaaaatgtagaatagtattgattctgttcctgtaatagaatctcagtggagtttttttgcaaaactaatatggatttcatctgattttattatttcttaaattttagattttattgagtaccatttatatgattgtacaagcattcactctttactagcattttttgtttttcagacaagctgaagtggttttattaagatttggtaatatttaaatagcaaccttctctgcctttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatagtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtattggcctgta

SEQ ID NO: 155115 - DNA, 624 bp, Homo sapiens
  Payload ID: 10492
  Gene Symbol: MZT2A
  Gene Name: mitotic spindle organizing protein 2A
  Uniprot ID: Q6P582
  ENST ID: ENST00000309451
  CDS Start-End: 47-523
tagggggcgcggcggggcggggcgcacctttcggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtccaggtca

SEQ ID NO: 155116 - DNA, 679 bp, Homo sapiens
  Payload ID: 10492
  Gene Symbol: MZT2A
  Gene Name: mitotic spindle organizing protein 2A
  ENST ID: ENST00000427024
  CDS Start-End: 1-421
gcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggcttgagtgacaacttgaggacaaggcggcgcctcaacaagatttcacacagcagctacgggggccagagaagcagcaccgcatggtgtggcaggagaaggaggacatgcacaagcaattggttgaagcttcagagacattgaaatcccaagccaaagaactgaaagatgcccatcagcagcaaaagctggccctgcaggagttcttggagctcaatgagctcatggcagagctctactcccagaagcagaagaccagctgagctagtgagcaagaaacacaagcactgaagctggaagcgtctgcatcaatttctgtggctgccagcacagaaccgcaggaagtaagacagcgttgtcctactgatgctctcacctggggtctgccctcatgtccaggtg

SEQ ID NO: 155117 - DNA, 933 bp, Homo sapiens
  Payload ID: 10493
  Gene Symbol: MZT2B
  Gene Name: mitotic spindle organizing protein 2B
  Uniprot ID: Q6NZ67
  ENST ID: ENST00000281871
  CDS Start-End: 356-832
tttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccagggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 155118 - DNA, 769 bp, Homo sapiens
  Payload ID: 10493
  Gene Symbol: MZT2B
  Gene Name: mitotic spindle organizing protein 2B
  ENST ID: ENST00000409255
  CDS Start-End: 27-683
agcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagaggcctcctttctctctgccaggaacagtagcccccctgcaaggccctccttttcctccagcccgcagcctgcggcctctccggttctgctccacagcccggctgccacacactcgcctctctctccaggccccccgggttccctccgcctctcttgctgcctgttctctccttttgcagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgc

SEQ ID NO: 155119 - DNA, 435 bp, Homo sapiens
  Payload ID: 10493
  Gene Symbol: MZT2B
  Gene Name: mitotic spindle organizing protein 2B
  ENST ID: ENST00000457492
  CDS Start-End: 1-366
gttgtggcggcctccggcgccccaaggtactttctccccagcaaggaatccgcgtgcgcgatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataat

SEQ ID NO: 155120 - DNA, 455 bp, Homo sapiens
  Payload ID: 10493
  Gene Symbol: MZT2B
  Gene Name: mitotic spindle organizing protein 2B
  ENST ID: ENST00000425361
  CDS Start-End: 1-368
gggggagggagtggtccttagctgaatgcgcctgcgttgtggcggcctccggcgccccaaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgca

SEQ ID NO: 155121 - DNA, 401 bp, Homo sapiens
  Payload ID: 10493
  Gene Symbol: MZT2B
  Gene Name: mitotic spindle organizing protein 2B
  ENST ID: ENST00000455239
  CDS Start-End: 1-363
gggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaaggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcaga

SEQ ID NO: 155122 - DNA, 2871 bp, Homo sapiens
  Payload ID: 10494
  Gene Symbol: MISP
  Gene Name: mitotic spindle positioning
  Uniprot ID: Q8IVT2
  ENST ID: ENST00000215582
  CDS Start-End: 104-2143
aggagtcagagtggaggctgcagactgtggagccgggagccggcagtaagcccagaggtctccaccccacgggaggaaggctgaggccaagaccccggaagagatggaccgcgtgaccagataccccatcctgggcatccctcaggcacaccgtggcaccggcctggtgctggatggagacaccagctacacataccatctggtgtgcatgggccccgaggccagcggctggggccaggatgagccgcagacatggcccactgaccacagggcccagcagggcgtgcagaggcagggggtgtcctacagcgtgcatgcctacactggccagccgtccccacgggggctccactcggagaacagggaggatgagggttggcaggtttaccgcctgggcgccagggatgcccaccagggacgtccaacatgggcactccgcccagaggacggggaggacaaggagatgaagacctaccgcctggatgctggggacgctgaccccaggaggctgtgtgacctggagcgggagcgctgggccgtcatccagggccaggcagtcaggaagagcagcaccgtggccacgctccagggcactcctgaccacggagaccccaggacccccggcccacctcggtccacgcccctggaggagaacgtggttgacagggagcagattgacttcctggcagcgagacagcagttcctgagtctggagcaggcgaacaagggggcccctcatagctccccggccagggggacccctgcaggcacaaccccaggggccagccaggcccccaaggccttcaacaagccccacctggccaacgggcacgtggttcccatcaagccccaggtgaagggggtggtcagggaagagaacaaggtgcgtgctgtgcccacctgggccagtgtccaagttgtggatgaccctggctccttggcctcagtggagtccccggggacccccaaggagacgcccatcgagcgggagatccgtctggctcaggagcgtgaggcagacctgcgagagcagagggggcttcggcaggcaaccgaccaccaggagctggtggaaatccccaccaggccgctgctgaccaagctgagcctgatcacagccccacggcgggagagagggcgcccgtccctctacgtgcagcgggacatagtacaggagacacagcgtgaggaagaccaccggcgggagggcctgcacgtgggccgggcgtccacacccgactgggtctcggagggtccccagcccggactccggagagccctcagctcagattccatcctcagcccggccccagatgcccgtgcggccgacccagctccagaagtgaggaaggtgaaccgcatcccacctgatgcctaccagccgtacctgagccccgggaccccccagctagaattctcagccttcggagcattcggcaagcccagcagtctctccacagcggaggccaaggctgcgacttcaccaaaggccacgatgtccccgaggcatctctcagaatcctctggaaaacccctgagcacaaagcaagaggcatcgaagccccctcggggatgcccgcaagccaacaggggtgtcgtgcggtgggagtacttccgcctgcgtcctctgcggttcagggccccagacgagccccagcaggcccaagtcccccatgtctggggctgggaggtggctggggcccctgcactgaggctgcagaagtcccagtcatctgatctgctggaaagggagagggagagtgtcctgcgccgggagcaagaggtggcagaggagcggagaaatgctctcttcccagaggtcttctccccaacgccagatgagaactctgaccagaactccaggagctcctcccaggcatccggcatcacgggcagttactcggtgtctgagtctcccttcttcagccccatccacctacactcaaacgtggcgtggacagtggaagatccagtggacagtgctcctcccgggcagagaaagaaggagcaatggtacgctggcatcaacccctcggacggtatcaactcagaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcc

SEQ ID NO: 155123 - DNA, 2005 bp, Homo sapiens
  Payload ID: 10495
  Gene Symbol: MIXL1
  Gene Name: Mix paired-like homeobox
  Uniprot ID: Q9H2W2
  ENST ID: ENST00000366810
  CDS Start-End: 65-763
cctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttgaggattctgggagaattcgggataagctctgaggagccatgactgacagcctgggagagacacatcagcatactgtcctttctgacttccatgctaaggacatgtccttgttaaccttgatgatggttttgacagcacctctcacatttgaaggtaccccgccactttgtcaatgacgttttaagcccacactcccaccccagagttcccgcattcgtttttacctgtgttctctccaagcctgcacattccattggtctgcatccctatgccttcttgccaggcctgtttttagtttttggactggttgttcagaactcattattttcttcacaagaatgcctcagcttgactcagtttccccttgtgtttgacagctgccattttctcctggtccctccaaggcttataatcttaaagtcactctaccccgtctcttcaaccctcatcctaggtttattactttttaaaattgggcctgtcatcttcacgttcaatcatagctccaatgactctgcatgcagattatttcgacagcccccttgcctctagcttctcaactacttaaaaaaaattaccctctgtgggccaggtgcagtggctcactcctgcaatctcagcactttgggaggccgagtgggtggatcacctgaagtcaggagttcaagaccagcctggccaatatggcgaaaccccatctctgctaaaaatataaaacttagctgggcacggtgacgggagcctgtagtcccagctactcaggaggctgaggcaggagaatcacttgagcctgggaggtggaggttgcagtgatctaagatcgtgccactgcacttcagcctgggagacagagggaggctctcaaaaaaaaaaaaaaaaaaaaaaaaaattactctatggttctgtggtagcctccagttgctaccaaattataaaaagctttcagttaccctcccagataactgatatcatccttagcctgcaggacagctatgcaaatctgaaggtcaactatccacaatatatgctttggtcttaaagtcactcctttcagttttgaaccaaattcataccttttgctttcaaaacactcgaggactccccacctgccttctgaagtctgaaattttctctaagtaatcctgattttgcacctgttacttcgatcactccattacccttagcacttgttattgtacttcctgtgcaagttttgtggattattaaatgtctttcacaaatg

SEQ ID NO: 155124 - DNA, 839 bp, Homo sapiens
  Payload ID: 10495
  Gene Symbol: MIXL1
  Gene Name: Mix paired-like homeobox
  Uniprot ID: Q9H2W2
  ENST ID: ENST00000542034
  CDS Start-End: 65-787
cctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccagcttttattttctcccctcttccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttgaggattctgggagaattcgggataagctctgaggagccatgactgacagcctg

SEQ ID NO: 155125 - DNA, 1781 bp, Homo sapiens
  Payload ID: 10496
  Gene Symbol: MLKL
  Gene Name: mixed lineage kinase domain-like
  Uniprot ID: Q8NB16
  ENST ID: ENST00000306247
  CDS Start-End: 341-1132
gacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtctttggaatcgtcctctgggaaatcgccactggagatatcccgtttcaaggtgaagaatgtgaagactggctcagccagtggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggtgcaaggagtgggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtcttaacactaa

SEQ ID NO: 155126 - DNA, 2523 bp, Homo sapiens
  Payload ID: 10496
  Gene Symbol: MLKL
  Gene Name: mixed lineage kinase domain-like
  Uniprot ID: Q8NB16
  ENST ID: ENST00000308807
  CDS Start-End: 465-1880
ggggccgtggctccgagctgcctagaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtatttaccaccaaaatgcatgcaggagatcccgcaagagcaaatcaaggagatcaagaaggagcagctttcaggatccccgtggattctgctaagggaaaatgaagtcagcacactttataaaggagaataccacagagctccagtggccataaaagtattcaaaaaactccaggctggcagcattgcaatagtgaggcagactttcaataaggagatcaaaaccatgaagaaattcgaatctcccaacatcctgcgtatatttgggatttgcattgatgaaacagtgactccgcctcaattctccattgtcatggagtactgtgaactcgggaccctgagggagctgttggatagggaaaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagcttgcaggatttgagttgaggaaaacacagacttccatgagtttgggaactacgagagaaaagacagacagagtcaaatctacagcatatctctcacctcaggaactggaagatgtattttatcaatatgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggtgcaaggagtgggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtcttaa

SEQ ID NO: 155127 - DNA, 1004 bp, Homo sapiens
  Payload ID: 10496
  Gene Symbol: MLKL
  Gene Name: mixed lineage kinase domain-like
  ENST ID: ENST00000573267
  CDS Start-End: 371-1004
tggggaaggcaggaagagtgtggaaaggacaggaggaaggaagggaggggccgtggctccgagctgcctagaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtatttaccaccaaaatgcatgcaggagatcccgcaagagcaaatcaaggagatcaagaaggagcagctttcaggatccccgtggattctgctaagggaaa

SEQ ID NO: 155128 - DNA, 458 bp, Homo sapiens
  Payload ID: 10496
  Gene Symbol: MLKL
  Gene Name: mixed lineage kinase domain-like
  ENST ID: ENST00000576529
  CDS Start-End: 1-307
gaaaaatcagaagctcaaacttcctggtaactcaaggctaccaagtgaagctttggaatcgtcctctgggaaatcgccactggagatatcccgtttcaaggtgaagaatgtgaagactggctcagccagtggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggtgcaaggagtgggcacgcttctctgttacaaatagaaaacgattccag

SEQ ID NO: 155129 - DNA, 781 bp, Homo sapiens
  Payload ID: 10496
  Gene Symbol: MLKL
  Gene Name: mixed lineage kinase domain-like
  ENST ID: ENST00000571303
  CDS Start-End: 1-527
ggtcagatttaccaccaaaatgcatgcaggagatcccgcaagagcaaatcaaggagatcaagaaggagcagctttcaggatccccgtggattctgctaagggaaaatgaagtcagcacactttataaaggagaataccacagagctccagtggccataaaagtattcaaaaaactccaggctggcagcattgcaatagtgaggcagactttcaataaggagatcaaaaccatgaagaaattcgaatctcccaacatcctgcgtatatttgggatttgcattgatgaaacagtgactccgcctcaattctccattgtcatggagtactgtgaactcgggaccctgagggagctgttggatagggaaaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagatttgggtacctggctgagtttggggctggcagccttcagcacaccaatggtgtcaatggcaggtgtgcatgggacaagaacatatgctgtcatgattgtgctacagtttctttaagaacaccagcttgcaggatttgagttgaggaaaacacagacttccatgagtttgggaactacgagagaaaagacagacagagtcaaatctacagcatatctctcacctcaggaactggaagatgtattttatcaatatgatgtaaagtctgaaata

SEQ ID NO: 155130 - DNA, 567 bp, Homo sapiens
  Payload ID: 10496
  Gene Symbol: MLKL
  Gene Name: mixed lineage kinase domain-like
  ENST ID: ENST00000575686
  CDS Start-End: 382-567
attctctgcaggcatcacagacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaataga

SEQ ID NO: 155131 - DNA, 8608 bp, Homo sapiens
  Payload ID: 10497
  Gene Symbol: MKL2
  Gene Name: MKL/myocardin-like 2
  Uniprot ID: Q9ULH7
  ENST ID: ENST00000318282
  CDS Start-End: 131-3280
aggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagccactcaatgacaaaaatagtaacagtgggaattcagctttgaacaatgccacacctaacacaccaagacagaatacatctactcctgtgagaaagccaggacctctgccttctagcctggatgacttaaaggtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagccagccacgctgtaggccagcccgtctctacaggtggccagacccttgttgccaaaaaggctgtagttatcaagcaagaggtccctgtgggccaggcagagcagcagagtgtcgtctcgcagttttatacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaagcctagttcacccccgccaccccagcaatttgtcgtccagcactctctatttgggagtccagtcgccaagacaaaagatcccccccgctatgaggaggccatcaagcagacacgcagcacacaggcccctctgccagagatttccaacgctcacagtcagcagatggatgacctctttgatatcctcattaagagtggagagatctccctccccataaaagaagaaccttctcctatttccaaaatgagaccagtgacagccagcatcaccacaatgccagtgaatacagtggtgtcccggccaccaccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacaggacctaccgctgccatgggactaacgtcacagatttcttttctgagagttgatgaggtttaagaacatgaagattctaaaaggtcagtttttagagatagatctatagttgcattgttgcaatcaaaatatgttgtcacagaaagaataggtggaaggtcatagcctggaacccaagtttgaaaacatttcattgtgttcagtagtgaatttctacagtttaacatagcacagggccttctgaaaatcgcacttgtcaaagacgactcatctatttctccagacttcagtaaagaatgaaaagtacctttagataaaaacaaagaagagtaatatatgcagcacagtgacgttaggattctggtaattaactacatttaaatctctggtcactttaagaccctaaataaaaggcagacagctccactcaaaaactaaggctgatgtgagggaggtgagaggtcactgcacttggtacttcctagagacggccggagccaggcccaagacacagcagaggtcaaaggcagtggagagccttggccagttcagtgacagcttctggctgaagacttttggttctattcagaaacctgtgtcgtttttttggtgttgtagtttattttgtgattttttggaatcgtactttatatttccaaatttaaatttaaatgcaagatctttcaacataaacagaagatacctacaaaatactgtcagaagtccaggtatactgataacactgaaaattctattagcaaccttctgggttggttagattgattttaatgtatatattagacatttgtatgtatgctctgacattgtgatttgtacagcctacgctggggtaaggaaatgggtatccaaggtcctacttttttaatagctcgaatatttctagagtacttgagccacatgtatttctgtatttaaagaattgctgactaactttcaggtaaccagacccatctcaaagaaccaagaaaaggctttagcatgaaatatctttctgagctggcgagttagaagaatggaaggtaaggggaaggtctgtcatctacccaggacattcccatgatgagtacaggtcagattgtgccacaaggtgggcctccacgtccctgccctggccctctttcttctgtcactaaccctggttatcattttacaggcttgtaactggatattctaccagagctctcactatattgtcaagcctaagattgaaaaactggaggctttattagtgtttttatatagaaaacagttattacatatgtgttaagtcatttcttaagaattttctaaaatgccaactatcacaggattatttcaagctagtcattgaggtatatgacaaaatgtaaataacaaaaaactgaaatctaccaaaagagcatggagatttttcttaaataataatattgtgctctccacctcacccttgtgtaaaccctcaggtcaggttggttcccctgggtcacaaaatggtaaatgttccatactgacatgccggaggcagcctgacccgttatttggaaagaatttgtgaattatttctgggtttgtgttttgcctaagagctgatcttatttctgatttgtgtgtgtgtggtttataaattttactacgtgtaacaaaagtctgcttttccagcatgagcacactggagccctctgctcactggcacttcctgactcaaaggcactaacagtgctcatgtgccttccagacggttcaaggcagaggccactgtgctcagtgtagtctgtgatgaatagtttaagtgttcagaaattggtaaaccaacacacgggatacaataactctctgttaaccagaacaccgtcatttgaccaagccctacaagagtttaccacactagatgttctgtgaatcctcgagtcagttccattgagaggggcctgtctccagggccaggctatttacttgggaaagtatttttcttacagttcttggccacagtttttttgctgagggtttctgtctgggcctatcaggtccatacttagaccctgagcatcttcttcattcagatttgaatggcttattaaattagcaccaaatatcagtgggactgtagaaggtaaccgaacactagtaccattgactctcgttgaataactttatatttccataatcctgaattgtgtagatagttttctagctctcgggtccctttattgctttttaaaatagggtttgaaacatgccacaggaaggttgctctccaaaaatacacagtgcagtgcaagaaaatgctatctcattggcctactctcctatgaattgctaaagtgcccacttcacatatgtgtttaaacctttataaaccagtatttcacttttaaaaagacaaggcatctctacccattaactctgcaagccactccacttgcaccattccgcttgaccctcctctctcctggcttgggtcaccagccaggcacctgtgacacgagtgctgctctccaggatctccactacatgttccaggttggagtgaggacgcgctatgtgctcacactcatgtgacatgaccaaagatgatactctgtaaacaaggcccttctgaccggactcagtgcgtgtgatggtgagtgcaatgaggaagggtggatattgactaaagactggttgttgttgttgtttaggttagtgtcacagccattacagcacaagtcaaagtcgccagttgaattttcattatgcacgtgtgtggtttaagcagtggtactgttgtatatcatattgtaaagtatcatactgccaagaaaataactcctagaaaggcattatctcacatccccatcttactttcctacatgttctcaaaacacagtagtaccagccttacctttctgctgtatgtagatagtcagatcatcctactgggggtgggatgaatttaaaagttataccaaaatttctgtaaagtctttgaaagtctaggagtaggtggtcatcttgtacatttcagcaaagcatccactaggaaacctcataggacagtgttagtggttcacgttctagtgtttttcctgaaatgtgcaatctactgtatagtattgccacataattgtacatagatgtattctgaatttgtggaatttcttgcttagatactattgtgtttgtttcatatgaatatttttgtaattctaaaagagatcttatttaaatttcctttttaaaagccgcatggttctgtgatccatgtaactgacactttttggctttcagtgctgtttagaaacagtggcaaaggcagggtggtgctgcctgcaagctgctgcctatggaaggcaaagtcatagtaatgagatagcacctctgaactgtgcagtcagcataccctgagtgatggctcaggggcgcactacctattttgtcaccagagctgactcaggcttcctggaccctcaaccccagatcattccaggcagcatagctttcttcacagtcctttcagaattcccaggctgaaatcagccatagcagttgacaaaacagctatccccacaagtgatgagatagtccctttactgtcctcaaatggacttggccttagagacgtggtaaagcactttggcagggtttaaaatatttgtgagaagcccacatttcagtatacatcctcactggcttccatgcacccacctgacggtagcctcacagaagtcctggctgtcactcaggtggggagctcatggtgccgctggggactttttagagaaatgtaaagagaatagctattcagtgtctactagcagagcaacatgtgtcaatttaaccaaattcacaaataaccctccatttttcaatatctgctactgtaaacatgaatattgaatactgacaagagaatacccatacaaatcgtcccaccgccctagaggccacagaattagcccaaaattatcaaagaacattaactggaaggtcaggtttttcaaggaacatagcttacaaatgcatcagtgtgtatctggagagcatcctaactgcatttcaactcatcttttaagtgatttcagtcaaaactggaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgt

SEQ ID NO: 155132 - DNA, 545 bp, Homo sapiens
  Payload ID: 10497
  Gene Symbol: MKL2
  Gene Name: MKL/myocardin-like 2
  ENST ID: ENST00000574998
  CDS Start-End: 336-545
gatcgcgcggcggcggcgggagcggcggcggcggcggccggggaggttcacaataaaggtgctaagaaagagaatgtaagacaggaaaataattaaatattcttaccgagatcactcctgtaaactctcacaagagatgtttataaaacacttggaacaatacagattgtactaagaaaatgtgctttgatcaactgtggagatacaaagcaggaaacttaataaatcaagtcctatttgtgaatggaaaggactggaagttcaccttaaaatgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggc

SEQ ID NO: 155133 - DNA, 3309 bp, Homo sapiens
  Payload ID: 10497
  Gene Symbol: MKL2
  Gene Name: MKL/myocardin-like 2
  Uniprot ID: Q9ULH7
  ENST ID: ENST00000574045
  CDS Start-End: 156-3305
ggagcggcggcggcggcggccggggaggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagccactcaatgacaaaaatagtaacagtgggaattcagctttgaacaatgccacacctaacacaccaagacagaatacatctactcctgtgagaaagccaggacctctgccttctagcctggatgacttaaaggtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagccagccacgctgtaggccagcccgtctctacaggtggccagacccttgttgccaaaaaggctgtagttatcaagcaagaggtccctgtgggccaggcagagcagcagagtgtcgtctcgcagttttatacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaagcctagttcacccccgccaccccagcaatttgtcgtccagcactctctatttgggagtccagtcgccaagacaaaagatcccccccgctatgaggaggccatcaagcagacacgcagcacacaggcccctctgccagagatttccaacgctcacagtcagcagatggatgacctctttgatatcctcattaagagtggagagatctccctccccataaaagaagaaccttctcctatttccaaaatgagaccagtgacagccagcatcaccacaatgccagtgaatacagtggtgtcccggccaccaccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacaggacctaccgctgccatgggactaacgtc

SEQ ID NO: 155134 - DNA, 696 bp, Homo sapiens
  Payload ID: 10497
  Gene Symbol: MKL2
  Gene Name: MKL/myocardin-like 2
  ENST ID: ENST00000571770
  CDS Start-End: 1-575
agatggatgacctctttgatatcctcattaagagtggagagatctccctccccataaaagaagaaccttctcctatttccaaaatgagaccagtgacagccagcatcaccacaatgccagtgaatacagtggtgtcccggccaccaccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacaggacctaccgctgccatgggactaacgtcacagatttcttttctgagagttgatgaggtttaagaacatgaagattctaaaaggtaaccagacccatctcaaagaaccaagaaaaggctttagcatgaaatatctttctgagctgg

SEQ ID NO: 155135 - DNA, 8799 bp, Homo sapiens
  Payload ID: 10497
  Gene Symbol: MKL2
  Gene Name: MKL/myocardin-like 2
  Uniprot ID: Q9ULH7
  ENST ID: ENST00000571589
  CDS Start-End: 173-3472
atcgcgcggcggcggcgggagcggcggcggcggcggccggggaggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagccactcaatgacaaaaatagtaacagtgggaattcagctttgaacaatgccacacctaacacaccaagacagaatacatctactcctgtgagaaagccaggacctctgccttctagcctggatgacttaaaggtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagccagccacgctgtaggccagcccgtctctacaggtggccagacccttgttgccaaaaaggctgtagttatcaagcaagaggtccctgtgggccaggcagagcagcagagtgtcgtctcgcagttttatgtgagttcccagggacagccaccgcctgctgttgttgctcagccccaggctttactgaccacgcagactgctcagctgctgctcccagtgtccatccagggctcgagtgtcacctcagtgcaactccctgtaggcagcctcaaactccagacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaagcctagttcacccccgccaccccagcaatttgtcgtccagcactctctatttgggagtccagtcgccaagacaaaagatcccccccgctatgaggaggccatcaagcagacacgcagcacacaggcccctctgccagagatttccaacgctcacagtcagcagatggatgacctctttgatatcctcattaagagtggagagatctccctccccataaaagaagaaccttctcctatttccaaaatgagaccagtgacagccagcatcaccacaatgccagtgaatacagtggtgtcccggccaccaccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacaggacctaccgctgccatgggactaacgtcacagatttcttttctgagagttgatgaggtttaagaacatgaagattctaaaaggtcagtttttagagatagatctatagttgcattgttgcaatcaaaatatgttgtcacagaaagaataggtggaaggtcatagcctggaacccaagtttgaaaacatttcattgtgttcagtagtgaatttctacagtttaacatagcacagggccttctgaaaatcgcacttgtcaaagacgactcatctatttctccagacttcagtaaagaatgaaaagtacctttagataaaaacaaagaagagtaatatatgcagcacagtgacgttaggattctggtaattaactacatttaaatctctggtcactttaagaccctaaataaaaggcagacagctccactcaaaaactaaggctgatgtgagggaggtgagaggtcactgcacttggtacttcctagagacggccggagccaggcccaagacacagcagaggtcaaaggcagtggagagccttggccagttcagtgacagcttctggctgaagacttttggttctattcagaaacctgtgtcgtttttttggtgttgtagtttattttgtgattttttggaatcgtactttatatttccaaatttaaatttaaatgcaagatctttcaacataaacagaagatacctacaaaatactgtcagaagtccaggtatactgataacactgaaaattctattagcaaccttctgggttggttagattgattttaatgtatatattagacatttgtatgtatgctctgacattgtgatttgtacagcctacgctggggtaaggaaatgggtatccaaggtcctacttttttaatagctcgaatatttctagagtacttgagccacatgtatttctgtatttaaagaattgctgactaactttcaggtaaccagacccatctcaaagaaccaagaaaaggctttagcatgaaatatctttctgagctggcgagttagaagaatggaaggtaaggggaaggtctgtcatctacccaggacattcccatgatgagtacaggtcagattgtgccacaaggtgggcctccacgtccctgccctggccctctttcttctgtcactaaccctggttatcattttacaggcttgtaactggatattctaccagagctctcactatattgtcaagcctaagattgaaaaactggaggctttattagtgtttttatatagaaaacagttattacatatgtgttaagtcatttcttaagaattttctaaaatgccaactatcacaggattatttcaagctagtcattgaggtatatgacaaaatgtaaataacaaaaaactgaaatctaccaaaagagcatggagatttttcttaaataataatattgtgctctccacctcacccttgtgtaaaccctcaggtcaggttggttcccctgggtcacaaaatggtaaatgttccatactgacatgccggaggcagcctgacccgttatttggaaagaatttgtgaattatttctgggtttgtgttttgcctaagagctgatcttatttctgatttgtgtgtgtgtggtttataaattttactacgtgtaacaaaagtctgcttttccagcatgagcacactggagccctctgctcactggcacttcctgactcaaaggcactaacagtgctcatgtgccttccagacggttcaaggcagaggccactgtgctcagtgtagtctgtgatgaatagtttaagtgttcagaaattggtaaaccaacacacgggatacaataactctctgttaaccagaacaccgtcatttgaccaagccctacaagagtttaccacactagatgttctgtgaatcctcgagtcagttccattgagaggggcctgtctccagggccaggctatttacttgggaaagtatttttcttacagttcttggccacagtttttttgctgagggtttctgtctgggcctatcaggtccatacttagaccctgagcatcttcttcattcagatttgaatggcttattaaattagcaccaaatatcagtgggactgtagaaggtaaccgaacactagtaccattgactctcgttgaataactttatatttccataatcctgaattgtgtagatagttttctagctctcgggtccctttattgctttttaaaatagggtttgaaacatgccacaggaaggttgctctccaaaaatacacagtgcagtgcaagaaaatgctatctcattggcctactctcctatgaattgctaaagtgcccacttcacatatgtgtttaaacctttataaaccagtatttcacttttaaaaagacaaggcatctctacccattaactctgcaagccactccacttgcaccattccgcttgaccctcctctctcctggcttgggtcaccagccaggcacctgtgacacgagtgctgctctccaggatctccactacatgttccaggttggagtgaggacgcgctatgtgctcacactcatgtgacatgaccaaagatgatactctgtaaacaaggcccttctgaccggactcagtgcgtgtgatggtgagtgcaatgaggaagggtggatattgactaaagactggttgttgttgttgtttaggttagtgtcacagccattacagcacaagtcaaagtcgccagttgaattttcattatgcacgtgtgtggtttaagcagtggtactgttgtatatcatattgtaaagtatcatactgccaagaaaataactcctagaaaggcattatctcacatccccatcttactttcctacatgttctcaaaacacagtagtaccagccttacctttctgctgtatgtagatagtcagatcatcctactgggggtgggatgaatttaaaagttataccaaaatttctgtaaagtctttgaaagtctaggagtaggtggtcatcttgtacatttcagcaaagcatccactaggaaacctcataggacagtgttagtggttcacgttctagtgtttttcctgaaatgtgcaatctactgtatagtattgccacataattgtacatagatgtattctgaatttgtggaatttcttgcttagatactattgtgtttgtttcatatgaatatttttgtaattctaaaagagatcttatttaaatttcctttttaaaagccgcatggttctgtgatccatgtaactgacactttttggctttcagtgctgtttagaaacagtggcaaaggcagggtggtgctgcctgcaagctgctgcctatggaaggcaaagtcatagtaatgagatagcacctctgaactgtgcagtcagcataccctgagtgatggctcaggggcgcactacctattttgtcaccagagctgactcaggcttcctggaccctcaaccccagatcattccaggcagcatagctttcttcacagtcctttcagaattcccaggctgaaatcagccatagcagttgacaaaacagctatccccacaagtgatgagatagtccctttactgtcctcaaatggacttggccttagagacgtggtaaagcactttggcagggtttaaaatatttgtgagaagcccacatttcagtatacatcctcactggcttccatgcacccacctgacggtagcctcacagaagtcctggctgtcactcaggtggggagctcatggtgccgctggggactttttagagaaatgtaaagagaatagctattcagtgtctactagcagagcaacatgtgtcaatttaaccaaattcacaaataaccctccatttttcaatatctgctactgtaaacatgaatattgaatactgacaagagaatacccatacaaatcgtcccaccgccctagaggccacagaattagcccaaaattatcaaagaacattaactggaaggtcaggtttttcaaggaacatagcttacaaatgcatcagtgtgtatctggagagcatcctaactgcatttcaactcatcttttaagtgatttcagtcaaaactggaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatg

SEQ ID NO: 155136 - DNA, 2185 bp, Homo sapiens
  Payload ID: 10497
  Gene Symbol: MKL2
  Gene Name: MKL/myocardin-like 2
  ENST ID: ENST00000572567
  CDS Start-End: 199-1308
gtatttgcaggtcaagctgggaactaaagggtaatggctgccttcagctgcttaaagacataattggccagtgattggggtattgtggggagcaaccagggacccagggaccagagtgttctgcgcaccgcacttcgctcttctgcaaattaagcttttctcctgcttgatgctgcctgtcttcagaagcctctcaccatgatcgatagctccaagaagcagcaacagggcttcccagagattttaactgctggggattttgaaccattaaaagaaaaggaatgccttgaggggagcaaccagaaaagtctcaaggaagtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagtacggcggggcccatgctatcctcaacgcggggttttctgtggttttttatgaggaactataagttaccaaaagttgaatgttgtcatttatttgtgctcagtaatgattttcatttctttgttatcagagcttatcacacagtgtctgaagtccacatggtgagagtggcctgcattccattccagtttctgtcctccaaaataggttctgaatttttacaagttagaaatgccttttcacaattattcatccagatttgcctattattagaacaccaaaatagtactagatgctctgagaaaagcgtaagtagtataatacctggcataaacagctaaaagaagagaaggatgggcatgaaagctggagtggtcaaaggaaagcctggtggaaaagacaggatctttgtatatagaaggctcgagaagggcctttccaggcacaggggaatgctgtgagcactagtacagaggaaggaatagagtaagtagtgcctcttcattggaaggtgagaaaaattgcctaaacaaagaatctgattaatttttaagtaaaaagtggaagacaaaaatcgagtacagccaatgtctaaggggacttgaagctgggcagaagaccttactcaacacagcagatagacaacggagtgcttcagagcaggctgctgacgcagtgaggccaaaatataagaaaaaacagctggatgctggtgttgaagggacgtctggagacaatgaagagctctggcagcagagtgagtgtttcagaagacagttaaaggccttggtgacgaacaactgcggagaaggaaggtgttttcaaagtttgaacccaactgtgggggacggaagggagtgaattctgacaatttctgaaactgaattcacagcaagacatcaatggctaattttaattacgtaataaagaaaatttctgga

SEQ ID NO: 155137 - DNA, 1938 bp, Homo sapiens
  Payload ID: 10497
  Gene Symbol: MKL2
  Gene Name: MKL/myocardin-like 2
  Uniprot ID: Q9ULH7
  ENST ID: ENST00000573051
  CDS Start-End: 159-1295
cggaagtaaggctggcgtagggccgccatgttgcagcaggatagtaatgatgacactaaagatgtttcactgtttgatgcggaagaggagacgactaatagaccaagaaaagtcaaaatcagacatccagtagcatcgtttttccacttattctttcgatgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaaagcttatcacacagtgtctgaagtccacatggtgagagtggcctgcattccattccagtttctgtcctccaaaataggttctgaatttttacaagttagaaatgccttttcacaattattcatccagatttgcctattattagaacaccaaaatagtactagatgctctgagaaaagcgtaagtagtataatacctggcataaacagctaaaagaagagaaggatgggcatgaaagctggagtggtcaaaggaaagcctggtggaaaagacaggatctttgtatatagaaggctcgagaagggcctttccaggcacaggggaatgctgtgagcactagtacagaggaaggaatagagtaagtagtgcctcttcattggaaggtgagaaaaattgcctaaacaaagaatctgattaatttttaagtaaaaagtggaagacaaaaatcgagtacagccaatgtctaaggggacttgaagctgggcagaagaccttactcaacacagcagatagacaacggagtgcttcagagcaggctgctgacgcagtgaggccaaaatataagaaaaaacagctggatgctggtgttgaagggacgtctggagacaatgaagagctctggcagcagagtgagtgtttcagaagacagttaaaggccttggtgacgaacaactgcggagaaggaaggtgttttcaaagtttgaacccaactgtgggggacggaagggagtgaattctgacaatttctgaaactgaattcacagcaagacatcaatggctaattttaattacgtaataaagaaaatttctggatatacattcccaatatgctttttctgggaaacagagataaaaa

SEQ ID NO: 155138 - DNA, 466 bp, Homo sapiens
  Payload ID: 10497
  Gene Symbol: MKL2
  Gene Name: MKL/myocardin-like 2
  ENST ID: ENST00000573434
  CDS Start-End: 1-159
atagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgaacattcctccatgttattaaatgttcctctcagctgggcatgatggctcacacctgtaatcccagcactttgggaggctgaggtgggaggatcatttaaggccaggagctcgagaccagcctgcacaacatagcaagactcctctacaaaaaatgtttaaagtagctgggcgtggtgatgcacgcctgtagtcccaactactcagaaggcaagagagaggttcccttgcaaccacaatctgggtgacacagccagatcctgtctttccctgtctgttaaaaaacaaaaacttctgaaataaaattactttttacttctttggctcat

SEQ ID NO: 155139 - DNA, 985 bp, Homo sapiens
  Payload ID: 10498
  Gene Symbol: MKRN2OS
  Gene Name: MKRN2 opposite strand
  Uniprot ID: H3BPM6
  ENST ID: ENST00000564146
  CDS Start-End: 93-764
aggttccttggggcggtgtgcattcgccaggtgtataatgaggaaaaggaagtctccggaaacctcccctagcattccaggaggcgaaagctatgcactgcgcagaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttagagagtatgatggaaggtctgatcttcatgttggaataactaacacaaatggggttgtgtataattacagtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaaggtagacagcaactggacaagggtgaatttacggagaagtacgtggtcccgcggacaaggctggcatccaagttcatcacactctaccgggcgatacgggagcatggcttctacgtcactgactgtccccagcagcaggcacaaccccctgagggcggcggtttgtgctgagagctatgtaagcgcagcctggacgctggagggtagggtggttgctacctttaatcagtactatggatttctaaatgcatttaactgtggttaataaaagcgtgtatgggccgggcatggtggctcacacctgtaatcccagcactttgggaagctaagacaggtaggtcacctgaggttgggagtttgagaccagcctgaccaacatggagaaaccccgt

SEQ ID NO: 155140 - DNA, 901 bp, Homo sapiens
  Payload ID: 10498
  Gene Symbol: MKRN2OS
  Gene Name: MKRN2 opposite strand
  ENST ID: ENST00000561645
  CDS Start-End: 59-289
ataatgaggaaaaggaagtctccggaaacctcccctagcattccaggaggcgaaagctatgcactgcgcagaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttaggggttgtgtataattacagtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaaggtagacagcaactggacaagggtgaatttacggagaagtacgtggtcccgcggacaaggctggcatccaagttcatcacactctaccgggcgatacgggagcatggcttctacgtcactgactgtccccagcagcaggcacaaccccctgagggcggcggtttgtgctgagagctatgtaagcgcagcctggacgctggagggtagggtggttgctacctttaatcagtactatggatttctaaatgcatttaactgtggttaataaaagcgtgtatgggccgggcatggtggctcacacctgtaatcccagcactttgggaagctaagacaggtaggtcacctgaggttgggagtttgagaccagcctgaccaacatggagaaaccccgt

SEQ ID NO: 155141 - DNA, 8427 bp, Homo sapiens
  Payload ID: 10499
  Gene Symbol: MLXIP
  Gene Name: MLX interacting protein
  Uniprot ID: Q9HAP2
  ENST ID: ENST00000319080
  CDS Start-End: 133-2892
cctccccctcccgccgcgccgcgcgctcgcggacagtcggcgcgcgggccgggccgggccggcgcccctctgcctcgcgcgcttgtcgcgttgccccgggctccgggggatgcccccggccgagcccttctcatggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgcgccgccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaaaaaaatttagccgtgtgtagcagtgagtgcctgtggtcccagctacttgggcctgaggctggaggattgcttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccatttcccgcccatgggccctgaccacactcccttttctagaagtcaatcctaaggtttctctgctctggctaagaggatgtaaatttggattcttagagggcatggcacccccagtccctgcccagataaagtagcacagtggcaggcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgtgcacgcgcgcgtgtgcgtgttgacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagcc

SEQ ID NO: 155142 - DNA, 805 bp, Homo sapiens
  Payload ID: 10499
  Gene Symbol: MLXIP
  Gene Name: MLX interacting protein
  Uniprot ID: Q9HAP2
  ENST ID: ENST00000377037
  CDS Start-End: 138-791
gaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccaggtgagccaggcggggagactcagtgcggggctccccccgacccagagggatgttttcccatcccaaaggctttcaaacttgtgaccaccaccaccaccctggtgtgcacgtgcatgcgcacacacatacacttaaatgaaacaaaagtgtcatgaaataatacatggcc

SEQ ID NO: 155143 - DNA, 1619 bp, Homo sapiens
  Payload ID: 10499
  Gene Symbol: MLXIP
  Gene Name: MLX interacting protein
  ENST ID: ENST00000535430
  CDS Start-End: 1399-1619
cagatctggagaagcgcaagaatcctgtgtgccactttgtgacacccctggacggctctgtggacgtagacgagcaccgccggccggaggtacttggcagtgaccaagggtggctgagagtggaaacataccagcacctcaccgggagtggctcaccgcgggctggtcctgtaggagaggctgccgagggtagtgcagcgcctgccctgcgccatccatgccctgggggccaggcctgggagctggtggcctctggcaaccccaggctgcagagcctcccccttctcagagggactggcccagggactgagggggttaatatctttctgttaatttttaaagtgtgtgtctatgtgtgattatacatgcacaggaagtgtctagaggaatatatagaagtgtctttattaagagacttcaggaacctctggggagtaggattagggctgccagatgagggggagatgctttcttcactgcatactcttctgtgtggctttaattttgtctaggcatgtctcactgttaacgataaagggggaatttagaaggtaagctaatgaaagacagttttgagacaggtataatctggtattagacagtatcaagggatatcattttgttgggtatggcaatattgtaatcagttctttttaacagaaaagcatctttgctgtcgaggacacacacacagtgtttgtaggtgaggtgatttgggccttgagatcagaaagtgaggcaaccccaggcattggggctccttatctctggagctcgaaggctgtcatgcaaggcatccacactggcatcacgcgaaggttggatgagaggcccctggagggcacattccacctgaaacttcctggaattggctgttcatttttgccctttgaatgtggcagaggctgtggggaaggggcatttatgggggggcttgggaattgctgcagcgttcccctgcttcttcctctgtggagcattctgctctcaccctgtcctcctggacagagcctcaggaccgtgcccccaaggcctttggctaccttaggtcttgaaatgacagcgcattgttagctagagggtctgctatagcatggaagaagtgggacgtactttctgagtgatgtggtagccactgtggggtttcccgctggattgcctaaggcctgattatagtgccggatactcagtacaccagttgagctttgctaatcaagcagagccccctcttcactctgctctctgtccctgtcctaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacct

SEQ ID NO: 155144 - DNA, 5097 bp, Homo sapiens
  Payload ID: 10499
  Gene Symbol: MLXIP
  Gene Name: MLX interacting protein
  Uniprot ID: Q9HAP2
  ENST ID: ENST00000538698
  CDS Start-End: 911-2491
gtgcagaggcacgattccatccctcttttacagcatccttcagcacccatggggtgggagactcttggtccaggtgtgcttctgcctgagtgccaggtaacctatgtgcagctagctctgctccgactaattaacacagaattagctagacagagaagaaaaacatggattactaataaaaataacttctgtatatttctttcacgttttactaagcaatccaaaaagttgcttacaggtgcttggggctacagagctgagtgaggtaccattctttgtccttacggagccctcatgcttatgcccatgaccagttagacactggtaacctggcaccatcttcaaacgggctccgggaagaattgctactgcagagactgggatctgaaccattgattcctcgtagcttttcttatttaggaagaggtggcctgatgaccagttgacacgtgaaattgtcctcggggattcccgagcagctgcaatccaggctgcctctgctcagtaatagaagatggcagagactttggggagactctgctggactccagaaacaagatattcccaggctgctagccagctgtgtgagggccgttgccttatctgagctctgagttatttagtttttaatggaaacaagacccccgcagacacgcagggaaacacaaatccctatcagatcagcagccatggacgtggagacgtggcctttgtccctctgtcccagcgcccggcctgtgtagttggacttggcagtgtgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctac

SEQ ID NO: 155145 - DNA, 513 bp, Homo sapiens
  Payload ID: 10499
  Gene Symbol: MLXIP
  Gene Name: MLX interacting protein
  ENST ID: ENST00000542417
  CDS Start-End: 1-513
tgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcattgatccattctctgtgggcagatactttccagccccaggggaaaggagtacgccagtccaaccaccttcgggtctgcagtccccagcccctctccgtgcttgccttttctttaaccacacac

SEQ ID NO: 155146 - DNA, 1682 bp, Homo sapiens
  Payload ID: 10499
  Gene Symbol: MLXIP
  Gene Name: MLX interacting protein
  ENST ID: ENST00000366272
  CDS Start-End: 759-1682
agtagttgggattacaggtgtgcgccactatactcggctaatttttgtttgtttgtttgttttttgagatggagtctcactctgtcgcctagctggagtgcagtggtgtgatctcggctcactgcaacctccgcctcctgggttcaagtgattctcctgcctcagcctcccgagttagctgggattacaggcgcccatcactacacccagctaattttttgtatttttagtagagatggggtttcaccatgttggccaggctggtctcgaactcctgatctcaggcgatctgcccaccttggcctcccaaagtgctgggattacaggtgtgagcccccacacccagtctctattctcttttttttttttttgagacggagtttcactgttattgcccaggctggagtgagatgacatgatcttggctcactgcaacctctgcctcccgggttcaagtgattctcctgcctcatcctcctgagtagctgagattacaggcatgtgccaccacacctggctaattttgtatcttcagtagagatggggtttcaccacattggccaggctggtctcgaactcctgacctctggtgatccacctgcctcggcctcccaaggtgctgggattacagatgtgagccattgcacccagcctctctatcttttttttaaagttagtcacaacctacagtgtgaaaacatggtcctggccatctctttcctgggtctataacatgtctccttcaagaagtcacacaaatggttttaggtgccttggtggctttgtcttcctgtcccctggggttgagaacaagctgtctcactggcagagaggcagcctctgcagggtgggccaggccctgtggcccagggctgcacctgaacatcctccttatcctggcagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattgta

SEQ ID NO: 155147 - DNA, 805 bp, Homo sapiens; identical to SEQ ID NO: 155142
  Payload ID: 10499
  Gene Symbol: MLXIP
  Gene Name: MLX interacting protein
  ENST ID: ENST00000628109
  CDS Start-End: 138-791

SEQ ID NO: 155148 - DNA, 513 bp, Homo sapiens; identical to SEQ ID NO: 155145
  Payload ID: 10499
  Gene Symbol: MLXIP
  Gene Name: MLX interacting protein
  ENST ID: ENST00000625214
  CDS Start-End: 1-513

SEQ ID NO: 155149 - DNA, 1682 bp, Homo sapiens; identical to SEQ ID NO: 155146
  Payload ID: 10499
  Gene Symbol: MLXIP
  Gene Name: MLX interacting protein
  ENST ID: ENST00000626863
  CDS Start-End: 759-1682

SEQ ID NO: 155150 - DNA, 5097 bp, Homo sapiens; identical to SEQ ID NO: 155144
  Payload ID: 10499
  Gene Symbol: MLXIP
  Gene Name: MLX interacting protein
  ENST ID: ENST00000625732
  CDS Start-End: 911-2491

SEQ ID NO: 155151 - DNA, 1619 bp, Homo sapiens; identical to SEQ ID NO: 155143
  Payload ID: 10499
  Gene Symbol: MLXIP
  Gene Name: MLX interacting protein
  ENST ID: ENST00000626676
  CDS Start-End: 1399-1619

SEQ ID NO: 155152 - DNA, 8427 bp, Homo sapiens; identical to SEQ ID NO: 155141
  Payload ID: 10499
  Gene Symbol: MLXIP
  Gene Name: MLX interacting protein
  ENST ID: ENST00000629738
  CDS Start-End: 133-2892

SEQ ID NO: 155153 - DNA, 3278 bp, Homo sapiens
  Payload ID: 10500
  Gene Symbol: MLXIPL
  Gene Name: MLX interacting protein-like
  Uniprot ID: Q9NP71
  ENST ID: ENST00000313375
  CDS Start-End: 49-2607
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 155154 - DNA, 3079 bp, Homo sapiens
  Payload ID: 10500
  Gene Symbol: MLXIPL
  Gene Name: MLX interacting protein-like
  Uniprot ID: Q9NP71
  ENST ID: ENST00000345114
  CDS Start-End: 1-1728
atggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 155155 - DNA, 3215 bp, Homo sapiens
  Payload ID: 10500
  Gene Symbol: MLXIPL
  Gene Name: MLX interacting protein-like
  Uniprot ID: Q9NP71
  ENST ID: ENST00000354613
  CDS Start-End: 49-2544
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaaccggcgtatcacacacatctccgcggagcagaagcggcgcttcaacatcaagctggggtttgacacccttcatgggctcgtgagcacactcagtgcccagcccagcctcaaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 155156 - DNA, 3252 bp, Homo sapiens
  Payload ID: 10500
  Gene Symbol: MLXIPL
  Gene Name: MLX interacting protein-like
  ENST ID: ENST00000434326
  CDS Start-End: 23-2188
ggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaagtacgtgagccatctccctgcctgctagagggacccagcctcgggggtggagggagcattccaccctgcttagatcccacatccagcttgccatcaacacagcctagggttgtggccaccccgcatcccccagatggtcctctggccaccagacgcctgtagacagaggttctaggagggggtgacagtcttgccaactaatacctccccctatccctttggttccacatccaagggtagggccctgaccccaggaagtgtctgtctctctctctctgtctcccacccagctgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtc

SEQ ID NO: 155157 - DNA, 690 bp, Homo sapiens
  Payload ID: 10500
  Gene Symbol: MLXIPL
  Gene Name: MLX interacting protein-like
  ENST ID: ENST00000453275
  CDS Start-End: 52-690
gttccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaa

SEQ ID NO: 155158 - DNA, 706 bp, Homo sapiens
  Payload ID: 10500
  Gene Symbol: MLXIPL
  Gene Name: MLX interacting protein-like
  ENST ID: ENST00000456640
  CDS Start-End: 1-706
cccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcgggtcagtgggggagggccagggaggccccagagctttcctcctgcggctgccggctaccgcccgcctcggaagatccctggaaaggggatcctgacccccgagcttgcgcccctcgggccctccattcagtcccgggccgacagcgccaccgtgtggccacagcgtctcctagcggcctccttacctaggggtcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatg

SEQ ID NO: 155159 - DNA, 3173 bp, Homo sapiens
  Payload ID: 10500
  Gene Symbol: MLXIPL
  Gene Name: MLX interacting protein-like
  Uniprot ID: Q9NP71
  ENST ID: ENST00000429400
  CDS Start-End: 1-2502
atggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 155160 - DNA, 3224 bp, Homo sapiens
  Payload ID: 10500
  Gene Symbol: MLXIPL
  Gene Name: MLX interacting protein-like
  Uniprot ID: Q9NP71
  ENST ID: ENST00000414749
  CDS Start-End: 1-2553
atggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggtt

SEQ ID NO: 155161 - DNA, 2586 bp, Homo sapiens
  Payload ID: 10501
  Gene Symbol: MLX
  Gene Name: MLX, MAX dimerization protein
  Uniprot ID: Q9UH92
  ENST ID: ENST00000246912
  CDS Start-End: 54-950
cctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcagcactgggcactgcctgtcagtttatgatattgtgt

SEQ ID NO: 155162 - DNA, 2334 bp, Homo sapiens
  Payload ID: 10501
  Gene Symbol: MLX
  Gene Name: MLX, MAX dimerization protein
  Uniprot ID: Q9UH92
  ENST ID: ENST00000346833
  CDS Start-End: 54-698
cctcgccgcagggggcccgcccgctggcccgtttccggtccggtgggtacaagatgacggagccgggcgcctctcccgaggacccttgggtcaaggtggagtatgcctacagcgacaacagcctggaccccgatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcagcactgggcactgcctgtcagtttatgatattgtgt

SEQ ID NO: 155163 - DNA, 2428 bp, Homo sapiens
  Payload ID: 10501
  Gene Symbol: MLX
  Gene Name: MLX, MAX dimerization protein
  Uniprot ID: Q9UH92
  ENST ID: ENST00000435881
  CDS Start-End: 58-792
gcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcagcactgggcactgcctgtcagtttatgatattgtgt

SEQ ID NO: 155164 - DNA, 796 bp, Homo sapiens
  Payload ID: 10501
  Gene Symbol: MLX
  Gene Name: MLX, MAX dimerization protein
  ENST ID: ENST00000591024
  CDS Start-End: 52-796
tcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagc

SEQ ID NO: 155165 - DNA, 867 bp, Homo sapiens
  Payload ID: 10502
  Gene Symbol: MMP24-AS1
  Gene Name: MMP24 antisense RNA 1
  ENST ID: ENST00000424358
  CDS Start-End: 88-303
gtcccttctttccgctccaacgcacggagggtgaggtcggtacgcggtggtggcgtcacggcgccagctcctcccgacgccgagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgt

SEQ ID NO: 155166 - DNA, 1499 bp, Homo sapiens
  Payload ID: 10502
  Gene Symbol: MMP24-AS1
  Gene Name: MMP24 antisense RNA 1
  ENST ID: ENST00000435366
  CDS Start-End: 23-238
gcgggtctggctgcgagagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaatggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaa

SEQ ID NO: 155167 - DNA, 712 bp, Homo sapiens
  Payload ID: 10502
  Gene Symbol: MMP24-AS1
  Gene Name: MMP24 antisense RNA 1
  ENST ID: ENST00000456790
  CDS Start-End: 125-340
gtcccttctttccgctccaacgcacggagggtgaggtcggtacgcggtggtggcgtcacggcgccagctcctcccgacgccgaggtgggttccgggagacccgcgggtctggctgcgagagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttatta

SEQ ID NO: 155168 - DNA, 3165 bp, Homo sapiens
  Payload ID: 10503
  Gene Symbol: MMS19
  Gene Name: MMS19 homolog, cytosolic iron-sulfur assembly component
  Uniprot ID: Q96T76
  ENST ID: ENST00000327238
  CDS Start-End: 1-2799
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 155169 - DNA, 3555 bp, Homo sapiens
  Payload ID: 10503
  Gene Symbol: MMS19
  Gene Name: MMS19 homolog, cytosolic iron-sulfur assembly component
  Uniprot ID: Q96T76
  ENST ID: ENST00000355839
  CDS Start-End: 226-3189
aatcgcctccggctgcgtgcccagcagccgccttccctctcggtgccaccgccccatttcaggccccgcccctccctggaactgcctaggcagaagccggcaggcacgtgaccccggcgccccgcccccttgcgcttccccggagattggctcgggaggcgcatgcgcggagagcccgtctcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaaggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 155170 - DNA, 3532 bp, Homo sapiens
  Payload ID: 10503
  Gene Symbol: MMS19
  Gene Name: MMS19 homolog, cytosolic iron-sulfur assembly component
  Uniprot ID: Q96T76
  ENST ID: ENST00000370782
  CDS Start-End: 72-3164
gcatgtgaccgacagcaccgccccctagggctgggcctgattttctcattggcttcccccgtgttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 155171 - DNA, 877 bp, Homo sapiens
  Payload ID: 10503
  Gene Symbol: MMS19
  Gene Name: MMS19 homolog, cytosolic iron-sulfur assembly component
  ENST ID: ENST00000422685
  CDS Start-End: 46-877
tcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaaggagcagagagtttaataggcaagaaggaagggaggaggaagaagctcccctgtacagagacagagcggggctccaaagccaagagagggaactccgcctgccacagataccagctagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagag

SEQ ID NO: 155172 - DNA, 776 bp, Homo sapiens
  Payload ID: 10503
  Gene Symbol: MMS19
  Gene Name: MMS19 homolog, cytosolic iron-sulfur assembly component
  ENST ID: ENST00000448660
  CDS Start-End: 52-348
tcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaaggtactggtgtcactaataggaatgtcttcctggattgctgagcccagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccct

SEQ ID NO: 155173 - DNA, 3401 bp, Homo sapiens
  Payload ID: 10503
  Gene Symbol: MMS19
  Gene Name: MMS19 homolog, cytosolic iron-sulfur assembly component
  Uniprot ID: Q96T76
  ENST ID: ENST00000415383
  CDS Start-End: 5-127
cgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 155174 - DNA, 609 bp, Homo sapiens
  Payload ID: 10503
  Gene Symbol: MMS19
  Gene Name: MMS19 homolog, cytosolic iron-sulfur assembly component
  ENST ID: ENST00000439048
  CDS Start-End: 16-537
tctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaaggtgatggatggggaaaaggatccccgtaatcttctggtggccttccgcatcgtccatgacctcatctccagggactatagcctgggaccctttgtggagga

SEQ ID NO: 155175 - DNA, 882 bp, Homo sapiens
  Payload ID: 10503
  Gene Symbol: MMS19
  Gene Name: MMS19 homolog, cytosolic iron-sulfur assembly component
  ENST ID: ENST00000434392
  CDS Start-End: 1-450
ctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagtaccccttgaaacgttacagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatc

SEQ ID NO: 155176 - DNA, 933 bp, Homo sapiens
  Payload ID: 10503
  Gene Symbol: MMS19
  Gene Name: MMS19 homolog, cytosolic iron-sulfur assembly component
  ENST ID: ENST00000437002
  CDS Start-End: 27-933
ccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccaga

SEQ ID NO: 155177 - DNA, 2164 bp, Homo sapiens
  Payload ID: 10503
  Gene Symbol: MMS19
  Gene Name: MMS19 homolog, cytosolic iron-sulfur assembly component
  ENST ID: ENST00000434538
  CDS Start-End: 1-1796
aatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 155178 - DNA, 3797 bp, Homo sapiens
  Payload ID: 10503
  Gene Symbol: MMS19
  Gene Name: MMS19 homolog, cytosolic iron-sulfur assembly component
  Uniprot ID: Q96T76
  ENST ID: ENST00000438925
  CDS Start-End: 337-3429
gattttctcattggcttcccccgtggtgcgtaccgcccctctccccacccagccaggtgcccgccccgcagcccgtctcccggggagccgggctgggaattattcgccctcaatcgcctccggctgcgtgcccagcagccgccttccctctcggtgccaccgccccatttcaggccccgcccctccctggaactgcctaggcagaagccggcaggcacgtgaccccggcgccccgcccccttgcgcttccccggagattggctcgggaggcgcatgcgcggagagcccgtctcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 155179 - DNA, 916 bp, Homo sapiens
  Payload ID: 10503
  Gene Symbol: MMS19
  Gene Name: MMS19 homolog, cytosolic iron-sulfur assembly component
  Uniprot ID: Q96T76
  ENST ID: ENST00000441194
  CDS Start-End: 49-171
gtctcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcaggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccg

SEQ ID NO: 155180 - DNA, 640 bp, Homo sapiens
  Payload ID: 10503
  Gene Symbol: MMS19
  Gene Name: MMS19 homolog, cytosolic iron-sulfur assembly component
  ENST ID: ENST00000444411
  CDS Start-End: 1-272
atgtgaagccaaactacttgaagggtctttctcatgtacttaacaggctgcccaagcctgtactcttgccagagctgcccacggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 155181 - DNA, 8643 bp, Homo sapiens
  Payload ID: 10504
  Gene Symbol: MMS22L
  Gene Name: MMS22-like, DNA repair protein
  Uniprot ID: Q6ZRQ5
  ENST ID: ENST00000275053
  CDS Start-End: 267-3998
gtttgcggtttagaccccaaagattcctgttggtggtctgggtcacaggaggcaggtttcgggagctggaaatgtgagcgggtacgacaggcaccgcgggtaaccgacgccccgggtccttgctgcagccgggtacgcgggataccggcaccccgccttctccgcccgagtgctgccaggcgtgggcctggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgggaaggtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaagctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttatgcattaaagaattatgggttctacttattcatcttctagaccacagaagtaaatggtttgtctcggaatcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagggtgtcattctagaagaacaattacgaatgtatcttcactgttgtttgacactttgtgatttctgggagccaaacattgcaattgttaccattttatgggaatattatagtaagaacctgaatagttccttcagtatttcttggcttccttttaaaggccttgctaataccatgaagtcacccttgtctatgcttgaaatggtgaagacttgctgttgcgataaacaagatcaggaactatataaatccagcagtagttatactatttttctttgtattctggcaaaagttgttaaaaaagcaatgaagagcaatggccctcatccttggaaacaagtcaaaggaagaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgcttttgtaacgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcagactttactttgctagcaatggacatgccaagcacagctccatcagattttcagcctcagccagttatatcaattattcaactttttggttgggatgatatcatctgccctcaagttgtagcaagatatttaagtcatgtcctacaaaatagcacattatgtgaagcactttctcattcaggctatgtatcttttcaagccttaaccgtaagatcatggattcgttgtgttttgcaaatgtatattaaaaacctctctgggcctgatgatttgctcatagataaaaatctggaagaggcagttgaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggcagtttatccaggattatggtatgaggtactattaccaggtttacagcattttagaaacagtagcaacattggaccagcaggttgtcatccacttgatttctacccttactcagtctctgaaggattcagagcagaaatggggccttggcaggaatatagcacaaagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaacattttctgagagtgttttctgtgtgtgagtattaagcagatacttcatccatagactttttgttgtagtatgacttcctgcctccctgccttgtgactgatttgtcatgtttattttttatttttacaataatagttatgttttaaaatgatactttttcaaagtacctggctaccctatactgtgtttttggtgggggaaaggtgttgggaaatgtgactgtgtatttgtttttcttttttatatgtgtgaggcaagttaacaaagaaaacccttacaaagcacacttaactgtgttaggaatgagactgaatctggctaaaggattatacagctgatatccaaaaagaagtgtaaacatgccaacagggtttatatttaggttccaagagttgccaaattttttttttattcatcctttcttttggagttgtcattaaaaaaaaaatcatatcaggaggaggaaataaaggagactttaagaggagagtaaataaaaatattctagaaaagtaacaatagtagtggtctgagaagtcagctgatccatcttcttgctctttagccagagcttcttataacttagcattttatccaagaaacctgtttagtttcctttaacaacattgtttctcaacttttgaactcttaactcatccagattgttttaccagttggagcttgtccttgactccttttcctattgagcattatttggttgaaagagctccagtcctagttttgggaacccacctgggtctcaaactcagctttgctttatgatcttgagctagttacgtaacctttctcagtctagtttcttcatggagaagaaaagaagaatccctttactatttgacagtgttgttgtgagaatcaatgggataatgtacgtgaaaatatttggtggcccaaattctgttgggaaatgtacagacacgattagtttattactcgtgcacaattaaggcaaagaacacctctcaattttatctttctctaatgatatgtcccagatgaatgatcccactttccaatgttttcttacatcatgttttctaactttgaagtactttgtttccttcttgggattatagtctttatcatggttctactcttccttcaagaaaacatttcaacccttctctggctcaaggagtatctttaaaaatgaaatactttgcaatcagtattctgtagttaatagcgttctcttaattataatctgtgaaatccaaaggagtgtctgttattttcataacatataaatggtccttctctcaaatcagcttcatcaaagggaataaatgaaagcttaaggctgtttaatagacttcataacactgaatttcttttcatcatgatagtgacttactaaacaaataatgtatggcttggaaagttccagcagtcactaaggagttttatctatttaaggtgatgcctttaaagaggttatttatgtgtatatgtgtttttgtgtgtgtgtgtgtgtgtgtgtgtgtgtgtgtgtgtgtgtgggttttttttttccaaaggagattgataaagatacctttgagaatcttgctccttagagtatgaaaacgtttaaaggataggaaaagctgctactgaatcatgctttaggacatatatctatagatactaagaataactaaaatttgtacttaagaatggtaacaacaaagtgtgtaacaatatgtgtgtgtattatatgttttgtatttatgtataagtaactttttttaaagcttttttttaaattgaaaaaagaagaaaatttatggctcagttccttttttttaaaatcttcactgatccttcacttattactacaatcttgccctctttcattcccagacttggagtcccttatacctgcttctttaatagccactttccctaaataccctgtaatttctgaggctgctgcttctaccagtgtaatacaagccattgtcttttggtcaaatctgagtttgttctcctttctcatgttctttgtcctctctgtgacaattgtattttcttttatcttcccatcatttccacaatggtactgctccttcctacatatacagttgacccttgagcaacacaagtttgaactgtgcaggtccacttatatgtggatctaaaatacagtatttgtgggatgcaaaatctgagtatatggaggaccaactttttgtagaggcaggttcctcagggttaactgcaggacttgagtaagtgcagattatggtatgcacaggggatcctggaaccagtccccagaccaaaaatgaccactgtatcttgagagcaccttcatggtcttctttcctgtccccagtcgtaagatacgacccttcatctgctttgtctcaacattctgttagtggtgaactgataactccagcttttctctctctttttttttttttttttttttttgttgttgttgttgttgttgttttgaggcagagtcttgctctgtcgcccaggctggagtgcagtggcacgatctcggctcactgcaagctctgcctcccgggttcacgccattctcctgcctcagcctcccaagtagctgggactacaggtgcccgccaccacgcccggctaattttttttgtatttttagtagagacggggtttcaccatgttgggctcgatctcctgacctcatgatccgcccgcctcggcctcccaaagtgctgggattacaggcgtgatgagccacctagtgctaattcatctctaaacctctgtagttggagtctcctgaaatctcagactacctcctgctttcattttctacccagggaatacactattgtcctaagttatttagccttgaaatgtcagaggcattttaggttcttcatgtttctcccactttcagttgattaccattacaggatcttaggcttctttttatctttttgcagtgccttgcatccactggttgtttgttttttctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaaacaagaggctcatttagcagctttctctgattgccatgttcatcctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaactta

SEQ ID NO: 155182 - DNA, 3949 bp, Homo sapiens
  Payload ID: 10504
  Gene Symbol: MMS22L
  Gene Name: MMS22-like, DNA repair protein
  ENST ID: ENST00000369251
  CDS Start-End: 77-3688
gaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgggaaggtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaagctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttatgcattaaagaattatgggttctacttattcatcttctagaccacagaagtaaatggtttgtctcggaatcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagaatagttccttcagtatttcttggcttccttttaaaggccttgctaataccatgaagtcacccttgtctatgcttgaaatggtgaagacttgctgttgcgataaacaagatcaggaactatataaatccagcagtagttatactatttttctttgtattctggcaaaagttgttaaaaaagcaatgaagagcaatggccctcatccttggaaacaagtcaaaggaagaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgcttttgtaacgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcagactttactttgctagcaatggacatgccaagcacagctccatcagattttcagcctcagccagttatatcaattattcaactttttggttgggatgatatcatctgccctcaagttgtagcaagatatttaagtcatgtcctacaaaatagcacattatgtgaagcactttctcattcaggctatgtatcttttcaagccttaaccgtaagatcatggattcgttgtgttttgcaaatgtatattaaaaacctctctgggcctgatgatttgctcatagataaaaatctggaagaggcagttgaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggcagtttatccaggattatggtatgaggtactattaccaggtttacagcattttagaaacagtagcaacattggaccagcaggttgtcatccacttgatttctacccttactcagtctctgaaggattcagagcagaaatggggccttggcaggaatatagcacaaagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaac

SEQ ID NO: 155183 - DNA, 436 bp, Homo sapiens
  Payload ID: 10504
  Gene Symbol: MMS22L
  Gene Name: MMS22-like, DNA repair protein
  ENST ID: ENST00000482634
  CDS Start-End: 1-267
aaatggtttgtctcggaatcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagagctgttaatgtagtgcttcatggcctagaggtcagacttgacctccttttaaaatagttttaaacatgctgttcatcacatttttaaacatattgtatggaagccctgtaaagttttgtaatatgttatcatttttgtaagagtttatggagaattataataaataatattttggaa

SEQ ID NO: 155184 - DNA, 721 bp, Homo sapiens
  Payload ID: 10504
  Gene Symbol: MMS22L
  Gene Name: MMS22-like, DNA repair protein
  ENST ID: ENST00000496119
  CDS Start-End: 192-614
ggagcgcgggcgcgcggtggcgggaatttcgcctgtttgcggtttagaccccaaagattcctgttggtggtctgggtcacaggaggcaggtttcgggagctggaaatgtgagcgggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatt

SEQ ID NO: 155185 - DNA, 3083 bp, Homo sapiens
  Payload ID: 10504
  Gene Symbol: MMS22L
  Gene Name: MMS22-like, DNA repair protein
  ENST ID: ENST00000509383
  CDS Start-End: 221-832
ggaatttcgcctgtttgcggtttagaccccaaagattcctgttggtggtctgggtcacaggaggcaggtttcgggagctggaaatgtgagcgggtacgacaggcaccgcgggtaaccgacgccccgggtccttgctgcagccgggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgggaaggtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaagctgtagtagaatcagaggttggttggaaggtacctttactatacaagtctattcagcagccccaaggtgggtttgtcttaaaccaacagatgaaaatatttcctgctttcaaagatcttcagtgaaagaatcctctaatgaacaagacagaggttttccctgagcttttgaatagtgctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttatgcattaaagaattatgggttctacttattcatcttctagaccacagaagtaaatggtttgtctcggaatcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagggtgtcattctagaagaacaattacgaatgtatcttcactgttgtttgacactttgtgatttctgggagccaaacattgcaattgttaccattttatgggaatattatagtaagaacctgaatagttccttcagtatttcttggcttccttttaaaggccttgctaataccatgaagtcacccttgtctatgcttgaaatggtgaagacttgctgttgcgataaacaagatcaggaactatataaatccagcagtagttatactatttttctttgtattctggcaaaagttgttaaaaaagcaatgaagagcaatggccctcatccttggaaacaagtcaaaggaaggtatatgcagtatcttctgtcatgagtgtgcactgatatctttggataggtgttactatttgtattttgttatgtttacttgggattagagtcttaattagttataatgttactaggtaatccattatatgcatttgattaaaagtgatagaaacaaacatcttcaagttgtacgttggtaggtaatagtttcaacatataaaacttttgtgttctttgagcccagcggttcacaagcactggtttttttggtttgttttgttttttaaatgagaactgaccacagtatagtagaaccagataactaatgttctcatttgggaactatgctgttttcatttctgataaaataaactttggtcacattagtccattgttttctctgtctcttttgagagttttgcttgttcaatgagtatacttttaaattgtctttcttttttctacttcctttgcctatattagctcttttcttagccttctttgtgcagtacaccaccatctaccacttgctcagattatttgttgagacctctcagggaagagaatactaggtagggacttctcaagaatcacttaatgaaattcctgtttgagtcccacagtgagtaattcttataagggtatggtgatatggtttggatatttcatttgtcatatactgttttaaatgccagcttctttattaaatctacaagaatcacatggcttaaacagtttttttttattttgttctatttgacagtttgtttttgaatcttaagcaattttatggaagacataatactcagaactttatggctaaaagaagtcattggagtttattcaataacaagtctattagacacatactatatgtcaagcactatagtggggatagtagtagacaatacaaagataattaaacagatttttacttttaagagtttgtcagcttttaagtatttataaacatttaactctcatgagcattactcatttctgtcctgaataagccagttatagaagttgcaaaacttaaggccaggtgtggtggctcacacctgtaatcccagcattttgggaggctgaggtgggcgtatcacttgagatcaggagtttgagaccagcctggacaacatggtgaaattctgtctctactaaaaaaaaaaaaaaaa

SEQ ID NO: 155186 - DNA, 966 bp, Homo sapiens
  Payload ID: 10504
  Gene Symbol: MMS22L
  Gene Name: MMS22-like, DNA repair protein
  ENST ID: ENST00000510018
  CDS Start-End: 1-966
tttggcattcagtgggttactgaaacagcattagtgaattcatctagagaactctttcatttattcaggcaacaactgtacaacttggaaaccttgttacagtccagttgtgattttgggaaggtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaagctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaagtcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagggtgtcattctagaagaacaattacgaatgtatcttcactgttgtttgacactttgtgatttctgggagccaaacattgcaattgttaccattttatgggaatattatagtaagaacctg

SEQ ID NO: 155187 - DNA, 2635 bp, Homo sapiens
  Payload ID: 10505
  Gene Symbol: MNAT1
  Gene Name: MNAT CDK-activating kinase assembly factor 1
  Uniprot ID: P51948
  ENST ID: ENST00000261245
  CDS Start-End: 102-1031
agcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaagttctgtggtttttctcttattacagtgttttacttgaacacattttaaataccattttgattacaacatttactgttaatatccaagtctattatttcttctcataaaatgttcccctttttcctaatgtcttgttaatactagtccagacaagtggatatatttcctttgaccaagttatggcaagaaaaacctgacccatgataatgtcattccctcaatactaaggactcaatgcctgttttaagcagtggaaaatgaggcaaaccttgatcaaggtgttatagttcccagctgtgagccacactcaggataaaacaaaacccagcattaacctgctttagtgacacattcaaagaagttaataaaatttaatacttaaatgatacctttcacctccaatgtaagctcattttatgatgaatcctttggagactggagaaggtacattttaagtacagttccctatgtataaattgtatactgatacagtttttttgttgaaacttcaaaggcttttattaccagggttttgcttaaagagtttagatatgaataggatgatattgcagcatctcaaccttgtatgagtctgttacatagagcattggatatgggatatagtttcttaaggaaattaagggatttcctatcaaatctctattacaacagatgttagttttatgggtagaaacttaggtgaaacaagacttgtggttacattaggatggactatccatctgtaacaactccatcttattttactaagcagttattaattaattttagcaatacatcttcatctttattgtacttctatctttgttaaatgagaaaaccaaggcatcaaataattgagtagacaaagatcatattcacaagttagtaaaaagccagaattagaatgcaggttttttttttcaaagtccagttccatctacattctaccagactgcatatcctattcctgtatctattaggtattcccgaactgaggattagtgtttttaagtacagtctataaatctgttcaaagaatagttagaacattgaatgtagagttaaggctttgcagcagccaattgcaaaaataaggaatccagtcttttgaaaagaaacactactgcttgttctcataccttttataaatgtattttaaaaagaatgaactaattaataaaacatatcaaaggcttttaaggcttgttttgagcctgccttattgtggaaattgcatgcacctggtttggcaaataaattccaaaaccttta

SEQ ID NO: 155188 - DNA, 1220 bp, Homo sapiens
  Payload ID: 10505
  Gene Symbol: MNAT1
  Gene Name: MNAT CDK-activating kinase assembly factor 1
  Uniprot ID: P51948
  ENST ID: ENST00000539616
  CDS Start-End: 88-891
ggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatatt

SEQ ID NO: 155189 - DNA, 680 bp, Homo sapiens
  Payload ID: 10505
  Gene Symbol: MNAT1
  Gene Name: MNAT CDK-activating kinase assembly factor 1
  ENST ID: ENST00000557134
  CDS Start-End: 1-510
actcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaaaggatttgacacgataagcctcatctgatggaagagaggaataaataattcacctatatgtgtttgaggttgtgacagacttataaaatctttttaaaaaataaagctataatttatattaa

SEQ ID NO: 155190 - DNA, 616 bp, Homo sapiens
  Payload ID: 10505
  Gene Symbol: MNAT1
  Gene Name: MNAT CDK-activating kinase assembly factor 1
  ENST ID: ENST00000554002
  CDS Start-End: 1-522
gttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttggaggatttgacacgataagcctcatctgatggaagagaggaataaataattcacctatatgtgtttgaggttgtgacagacttataaaatctttttaaaaaataaagctataatttatattaa

SEQ ID NO: 155191 - DNA, 3785 bp, Homo sapiens
  Payload ID: 10506
  Gene Symbol: MOB4
  Gene Name: MOB family member 4, phocein
  Uniprot ID: Q9Y3A3
  ENST ID: ENST00000233892
  CDS Start-End: 151-732
gtcgatttcacgcaggttctatagaatttgccaagactgctggcctgttttctaccctgattccttaggtggcttctgggacagaattacggttctctaagtatttgcttgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaatgagcctggcaaaccattgatttataaaagtaagtgttctaagaggggaacaagacagttctgtgtgataaggaagttaggctccactttttgtttgaattaccctatgtatatccgaaggtaaacttaggcttttctttccaaaagatcgtatagtcaattcattctttttctcctatcacatctgggaaagtagctaacttttaactatttatgttcccataagtaacccttcttttgtgtgtatacatttccttttctctgacttgagatgtcaaatttggatttctagaacagtttctcagttaaattcttgatgacttaacaacttttactatcagaatacaattagaaatccttggtcaggcacaggggctcacgcctgtaatcccagcactttgggaagccaaggcagacagatcacctgaggtcaggagttcgagaccagcctgaccaacatggagaaaccctgtctctactaaaaatacaaaaattagccgggcgtggtgctactcgtgaggctgaggcaggagaatcgcttgaacccgggaggtggaggttgcggtgagctgagatcgtgccattgcactccagcctgggtaacgagcaaaactccgtctcaaaaactccgtctcaaaaaaaaaaaatccttgattacattgttagtaaggactgtgttacgattataaacacatttattggttgatgtcaaattcactgtaatagtagaactaagttttttatgtgagtactttgccctactgtctatatgatgacatcttttttgagcagctaaattttaaattgtatatactttattttgtgaatccttgttgaatgtgctaaaggtttctttgtgtagttcttccatgctatgcgaatattttagtaaaagtagttgattttta

SEQ ID NO: 155192 - DNA, 3986 bp, Homo sapiens
  Payload ID: 10506
  Gene Symbol: MOB4
  Gene Name: MOB family member 4, phocein
  Uniprot ID: Q9Y3A3
  ENST ID: ENST00000323303
  CDS Start-End: 256-933
aaagaggctcgtggcgcccgccttccggtgcctcagtccctgccagtagccacccgacgccgtccggctgttcctcgttcgccctctccctccgcctagcccgcttctacccggacggctcccggcgcaggctgcagctgttccgtcagctgccgctcctcctcccagacgcagagcgccgctctgccccgccccccgcgcaggctgccgtccctacatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaatgagcctggcaaaccattgatttataaaagtaagtgttctaagaggggaacaagacagttctgtgtgataaggaagttaggctccactttttgtttgaattaccctatgtatatccgaaggtaaacttaggcttttctttccaaaagatcgtatagtcaattcattctttttctcctatcacatctgggaaagtagctaacttttaactatttatgttcccataagtaacccttcttttgtgtgtatacatttccttttctctgacttgagatgtcaaatttggatttctagaacagtttctcagttaaattcttgatgacttaacaacttttactatcagaatacaattagaaatccttggtcaggcacaggggctcacgcctgtaatcccagcactttgggaagccaaggcagacagatcacctgaggtcaggagttcgagaccagcctgaccaacatggagaaaccctgtctctactaaaaatacaaaaattagccgggcgtggtgctactcgtgaggctgaggcaggagaatcgcttgaacccgggaggtggaggttgcggtgagctgagatcgtgccattgcactccagcctgggtaacgagcaaaactccgtctcaaaaactccgtctcaaaaaaaaaaaatccttgattacattgttagtaaggactgtgttacgattataaacacatttattggttgatgtcaaattcactgtaatagtagaactaagttttttatgtgagtactttgccctactgtctatatgatgacatcttttttgagcagctaaattttaaattgtatatactttattttgtgaatccttgttgaatgtgctaaaggtttctttgtgtagttcttccatgctatgcgaatattttagtaaaagtagttgattttta

SEQ ID NO: 155193 - DNA, 1130 bp, Homo sapiens
  Payload ID: 10506
  Gene Symbol: MOB4
  Gene Name: MOB family member 4, phocein
  ENST ID: ENST00000409355
  CDS Start-End: 4-159
actatggtcatggcggaggggacggcagtgctgaggcggaacaggccgggcaccaaggcgcagtatattcaacagaacataagagcagattgctccaatattgacaaaattcttgaaccacctgaaggccaagatgaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatac

SEQ ID NO: 155194 - DNA, 829 bp, Homo sapiens
  Payload ID: 10506
  Gene Symbol: MOB4
  Gene Name: MOB family member 4, phocein
  ENST ID: ENST00000409916
  CDS Start-End: 279-659
cgcaggttctatagaatttgccaagactgctggcctgttttctaccctgattccttaggtggcttctgggacagaattacggttctctaagtatttgcttgcagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataag

SEQ ID NO: 155195 - DNA, 1447 bp, Homo sapiens
  Payload ID: 10506
  Gene Symbol: MOB4
  Gene Name: MOB family member 4, phocein
  Uniprot ID: Q9Y3A3
  ENST ID: ENST00000409360
  CDS Start-End: 233-814
acttttcttgtcgggcaactaggtgccgagcagtgctgcgcccggaagctggccgccactgcggggaggttgggccgaggcggcaggcgggcgggctggggcactggtgcccggcctgctcttccggagctgcagcccctcaatttggctgaggcggtggcggccgccgtgaggcctgcggagctccgacccaggggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacgga

SEQ ID NO: 155196 - DNA, 1198 bp, Homo sapiens
  Payload ID: 10506
  Gene Symbol: MOB4
  Gene Name: MOB family member 4, phocein
  ENST ID: ENST00000417097
  CDS Start-End: 14-151
agacgctggcactatggtcatggcggaggggacggcagtgctgaggcggaacaggccgggcaccaaggcgcaggatttctataattggcctgatgaatcctttgatgaaatggacagtacactagctgttcaacaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaa

SEQ ID NO: 155197 - DNA, 1021 bp, Homo sapiens
  Payload ID: 10506
  Gene Symbol: MOB4
  Gene Name: MOB family member 4, phocein
  Uniprot ID: Q9Y3A3
  ENST ID: ENST00000448447
  CDS Start-End: 41-655
acatccgggtaccgactccagccgcctagacgctggcactatggtcatggcggaggggacggcagtgctgaggcggaacaggccgggcaccaaggcgcagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaa

SEQ ID NO: 155198 - DNA, 4885 bp, Homo sapiens
  Payload ID: 10507
  Gene Symbol: MOB1A
  Gene Name: MOB kinase activator 1A
  Uniprot ID: Q9H8S9
  ENST ID: ENST00000396049
  CDS Start-End: 195-845
gcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaagaaatgactgattaaagtatgtatatcaacacacatttctatttaaatatagaaacttgagagttttgca

SEQ ID NO: 155199 - DNA, 6963 bp, Homo sapiens
  Payload ID: 10508
  Gene Symbol: MOB1B
  Gene Name: MOB kinase activator 1B
  Uniprot ID: Q7L9L4
  ENST ID: ENST00000309395
  CDS Start-End: 202-852
gagcgctacccacttccgccccctccccctgccattggaactagctgagccgaactagttgcggccaccgagcagccggctctcggcacctcctcctccgcctccctgtctcctgttccattcgcctttcctcttctttcctggcccacgccgctccgaggcctcgcgaccgccgagcctgcagcctgccccgcggccaacatgagcttcttgtttggtagtcgctcttctaaaacttttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggatttcttcaatcagatcaacatgctttatggaactatcacagacttctgtacagaagagagttgtccagtgatgtcagctggcccaaaatatgagtatcattgggcagatggaacgaacataaagaaacctattaagtgctctgcaccaaagtatattgattacttgatgacttgggttcaggaccagttggatgatgagacgttatttccatcaaaaattggtgtcccgttcccaaagaatttcatgtctgtggcaaaaactatactcaaacgcctctttagggtttatgctcacatttatcatcagcattttgaccctgtgatccagcttcaggaggaagcacatctaaatacatctttcaagcactttattttttttgtccaggaattcaaccttattgatagaagagaacttgcaccactccaagaactgattgaaaaactcacctcaaaagacagataaaaggatgcagagctgtgcaaattgttcctcaaatgaagcagtgtggagtgtattggggattttgttatattttgtttttatctggattgtttttgtcctaggtttgggggcgggggcttgtttgggttcctttttctttattctgattatgtgaaaccatattctattgctaggggaagccaagaaccattctctatacacttgataagggtaaatttatcttagtgtttttaaacttggttttggttacttgaggagttttttaataatattgtgtgctgcaagaaagtgcttgttgattgaactgccgatggattggtttctgtgtggtataaattgtggcccatttatgaagtccccaaaagagttatgtttttaagtgccttggcaggctcacttctgaggtgcaaaacatagatatagaactgaacagggcttgaaacaatattaggattactacccagggcacttactggtgcatgttgtaacatatctatgataaaagccatagtttacctaaaatggtgatttccagcctttactgctttgaagaaacagaatttgtaaaggtatgcatgtagaacataaaaaatatttcttaattattttttatattgatggtaatatattacgttcaacaatgcttaaagctctacaagcaggtcttttcccacctcttgatatctgtgatactgaaacttgaggatgttgaaatgtattacattttggcttctttctacatgttaactgcactgtagatgtaaaaattcaggttatatataggattgccatcttcagaggtgatgctgaactgtgaggtttcctagtaattgccaaatgagccgtaagtctgcagaattcccttctactttgaagagaaggggataggaatgtatatttggctgggggcatggagatgttcgtatgtatgaggagttagggatggggagtcaagttctagaaagttttgtctgaaaacctttgaatagaatggcatgaagattttaatcaattacttataaacaaagtcttagagacttccttttaggaatcaacttccatgagaagttaaaaataaattattaattttaggtacagacattaaacatggaatttaaggactgttgggggaaattgatcacttcttagcatttccattcagtgaatggagctgatgtttgcctgtcattttaagatgataccataccttctttggttattataggtccagtttgaagcattctgacttctggtttttccaccctgaaaggaaatgtttttctttgcagcagtattagataatgaaaaatgctaattcagtagttattaacttctaaattttattcgccatgactttctagtgaattattaccataaataacaatttcagaaacttagtttttagaataaatattaatttttccacttcagttttattctagaaaataccctttttagaaatccagttttagttttgtcattttcgataaatctttcttcagttagaaatatatatccttccttcagttgaaacatatacctttttcacatctaggaagaaatgcttgctctgaaatagtatagattaaaaacactcagtagaaaagaatctaaaattaaatgaatttgttttgccattaaagtagagcagtgatacaatttaatgccattacaattatgttgactagaaactgcctttttctccacttcatttctagcaattatttaccaagtaccaacagtagaagtaacaggaaagcctggcagagttaaatatcttggacatttattggtaaagcttatttataaactgcagtcagagctagttaatttccttaaatctttttgtattcagatagataatatgaatcattatgggttgattcagaaataaaatttgtgaggtgattttgaatcttgtccatataggaaaatgaagcacagaattactcagtcttccatattgtatttgacttcatatcaatctagtaaaaaaggagttgcaatagccaagtatagagagaatagtgaaaaattaatcttgccctttcaagccttatacagtagtacactgtacttgtttttagtagtaagacctactttcccactatatgtagatagtttgttttcactgtgccagaatctcaggtgcctgcttagagtatttctttaatcacagtcactgggaagtaaggagatgtatatatgtgtatatatggtaacaaagcatagcagttctctaggggagaggcctggcattgcacatggtgttacatggctacaagtaaggaaaaaatcagaaagtgaaagaactgatgtaataaaaggttgatttggttggttcccatgaaagttagtaagatgcccttttaaatataaggatcagtgctttgttctgcagcagagtttgctgataaatgtctgttggattctttttggatttctttaattaatttgtaagtaaccaagataattattttcccccttgctctctatattaatacgtagctataaagcaacagttggttttcttatcctttgataaaagcatcccataaaatataaagtagtaagttaacatagtattattgtcacacacaatgctttttttggttaaatgttgatacgaagcaatgttttggaattactttaattgatggagtagtggtggtagagagaaattaataacaaaaagagtgaaaatattttaattagcagtagatggtgctactggctttcatttgctgacttgattattccctttctcttaaaaaccatggcattagactgcactaaattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatacttttgtttacccctctctgagacaggttttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcaggaaaatcagtttcatcattttagttacactaaacacttttggcagcttaatatgacctttttaaattttttttattttttttatttttatttctttaagatggagtcttgctctgttgcccgggctggagtacaatggcatgatctcagctcactgcaacctccacctcctgggttcaagcatttctcctgcctcagcctcccaagtagctgggattacaggcagcaccacacctggctaattttcatatttttagtagagatggggtttcaacatattggccaggctggtctcaaactcctgacctcaagtgatccgccctccccagcctcccaaagtgctgggattacaggtgtgagccaccacagccagccagtatgacctatcttaatcatcagctcaactgtaatttaaatttggctgttctctggagctaaaccattagggaagttcaaaggaatgtgccatgatttccgaatttgcacaagagaatgttttaagcattggtagcataattgaataaaagaatagtttcctgatgtcactattttgaagtggaaattatcacttggatgtggaggttttactttttaaaaacattcagcttaattaccttaccttaattaccttagttagatatactaatggaaaaaaaccaagtcctttctctagaacttgttttctatttttgttccttttcatgaaaacttctcaatttaattttaactactgtaggatagtattgattgaatggatactatggaaaagtggatccaatatttaagatagaagtagtttaaggagacaacagcctttactgccatttttttttaaatgttttcactcagatgaacaatttgactttaataaaagactggagatttttgtacaaagaaataggaataagtttcatatactaattatgctgagttttaagcctacatatcacaaaatatttagaattgtataaccttttcatatatttataacttttaatgtctttttaaaagatgtgggaccaaaaatatatttataatttggaaatgtgactgcataccaataagaaaacttaccttattttgaaatttatctgggatattaaagaatctaccaattcttaaaaacacagatttatactttaagcttattttaaaattaaagaatatataccaattcttagaaacactttaaggactactcttaaataacttaaatatcagagttttgttgtaatattaaaatttaccgtggaaatcactgttgttcagctatcaccttaattgtgtatgatatgataaatgtttagcagtaaagctatcttaagatttaatggaaaagtttaatttgaagatgtaacaaaaattctgaccacagttgattctgaatttttaaggctttcctaataggctgatcacagagaataatccattttgaaggtataaaactgcactgtatgtctgtcacttgtagctgaactgattcacattttgacaaaagagagaaaatacaaaaatgagttttgcaaatgtaataactttttctgcatatagaactaaataattgaaaaatatgggctatagttctcaaaggtagatagtaaaatcactggctttttccagctgtatgtttttccactgtgcgtgtacacacacactggaaaataattaggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtggtgagggcactaatcttgtaggaaacacttacttgatgttttatttgaacttttcctataggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatgggatgggaaatatttaaattctaggtgtttttttttttttaaagaagaaactcaatgtttataagaaaaaaatgaataaatagttacgtttggccatgaa

SEQ ID NO: 155200 - DNA, 1107 bp, Homo sapiens
  Payload ID: 10508
  Gene Symbol: MOB1B
  Gene Name: MOB kinase activator 1B
  Uniprot ID: Q7L9L4
  ENST ID: ENST00000396051
  CDS Start-End: 257-922
agctgagccgaactagttgcggccaccgagcagccggctctcggcacctcctcctccgcctccctgtctcctgttccattcgcctttcctcttctttcctggcccacgccgctccgaggcctcgcgaccgccgagcctgcagcctgccccgcggccaacatgagcttcttgttgagttctcagcctgaagttgactggaactttcagttaacaagtatttatcgaatacctgatctgtagtgttggacttagacctatggaaggagctactgatgtgaatgaaagtggtagtcgctcttctaaaacttttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggatttcttcaatcagatcaacatgctttatggaactatcacagacttctgtacagaagagagttgtccagtgatgtcagctggcccaaaatatgagtatcattgggcagatggaacgaacataaagaaacctattaagtgctctgcaccaaagtatattgattacttgatgacttgggttcaggaccagttggatgatgagacgttatttccatcaaaaattggtgtcccgttcccaaagaatttcatgtctgtggcaaaaactatactcaaacgcctctttagggtttatgctcacatttatcatcagcattttgaccctgtgatccagcttcaggaggaagcacatctaaatacatctttcaagcactttattttttttgtccaggaattcaaccttattgatagaagagaacttgcaccactccaagaactgattgaaaaactcacctcaaaagacagataaaaggatgcagagctgtgcaaattgttcctcaaatgaagcagtgtggagtgtattggggattttgttatattttgtttttatctggattgtttttgtcctaggtttgggggcgggggcttgtttgggttcctttttctttattctgattatgtgaaaccatattctattgctaggggaagccaaga

SEQ ID NO: 155201 - DNA, 760 bp, Homo sapiens
  Payload ID: 10508
  Gene Symbol: MOB1B
  Gene Name: MOB kinase activator 1B
  ENST ID: ENST00000502869
  CDS Start-End: 369-760
gattcaagacgagcgctacccacttccgccccctccccctgccattggaactagctgagccgaactagttgcggccaccgagcagccggctctcggcacctcctcctccgcctccctgtctcctgttccattcgcctttcctcttctttcctggcccacgccgctccgaggcctcgcgaccgccgagcctgcagcctgccccgcggccaacatgagcttcttgttagagaaggttcatattgtcggattatgaaagactcaaaataaagaactggaggcaaagaagagttctcagcctgaagttgactggaactttcagttaacaagtatttatcgaatacctgatctgtagtgttggacttagacctatggaaggagctactgatgtgaatgaaagtggtagtcgctcttctaaaacttttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggatttcttcaatcagatcaacatgctttatggaactatcacagacttctgtacagaagagagttgtccagtgatgtcagctggcccaaaatatgagtatcattgggcagatggaacgaacataaagaaacctattaagtgctctgcaccaaagtatattgattacttgatgacttgggttcaggaccagtt

SEQ ID NO: 155202 - DNA, 1207 bp, Homo sapiens
  Payload ID: 10509
  Gene Symbol: MOB2
  Gene Name: MOB kinase activator 2
  Uniprot ID: Q70IA6
  ENST ID: ENST00000329957
  CDS Start-End: 191-997
aattcagacgctccctcgtttcaccagccttggccagcccttgcctctggaaagggggcagctgtttgtctctgccaggcgtcccattggccagggagtgaggctggagggcccggcagcaggcatttgcgagtgctggccagccggcaccccgccccgcttctcctccccaccttcccgtcgcccactcatgctgggagaccactgcagtctccctgaagaccaagcccggcccggccagtccctgcaaagtggactctgctgcaaaatggtgcttcaggctgtcagcaaagtgctcaggaagtccaaagccaagcctaatggcaagaagcccgctgcggaggagaggaaggcctacctggagcctgagcacaccaaggccaggatcaccgacttccagttcaaggagctggtggtgctgccccgcgagattgaccttaacgagtggctggccagcaacaccacgacgtttttccaccacatcaacctgcagtatagcaccatctccgagttctgcacaggagagacgtgtcagacgatggccgtgtgcaacacacagtactactggtatgacgagcgggggaagaaggtcaagtgcacggccccacagtacgttgacttcgtcatgagctccgtgcagaagctggtgacggatgaggacgtgttccccacaaaatacggcagagaattccccagctcctttgagtccctggtgaggaagatctgcagacacctgttccacgtgctggcacacatctactgggcccacttcaaggagacgctggccctggagctgcacggacacttgaacacgctctacgtccacttcatcctctttgctcgggagttcaacctgctggaccccaaagagaccgccatcatggacgacctcaccgaggtgctatgcagcggggccggcggggtccacagtgggggcagtggggatggggccggcagcgggggcccgggagcacagaaccacgtgaaggagagatgagccccccgggccggacaggggcacacgtgtgcaaagagacggtggtgtgtgttctctcctgcatctgcgtgtgcacacatgtgctgggcacgcgtgtggtgaggtctgagagggccccgggctgcactggtgtgggctgcacaggcacagacgcagacggccccggccgtgtcctgtggccccctgtcggatggatgcgtgccgtttgta

SEQ ID NO: 155203 - DNA, 1425 bp, Homo sapiens
  Payload ID: 10509
  Gene Symbol: MOB2
  Gene Name: MOB kinase activator 2
  ENST ID: ENST00000614710
  CDS Start-End: 1-711
ggttggaggacttggaagtccaaagccaagcctaatggcaagaagcccgctgcggaggagaggaaggcctacctggagcctgagcacaccaaggccaggatcaccgacttccagttcaaggagctggtggtgctgccccgcgagattgaccttaacgagtggctggccagcaacaccacgacgtttttccaccacatcaacctgcagtatagcaccatctccgagttctgcacaggagagacgtgtcagacgatggccgtgtgcaacacacagtactactggtatgacgagcgggggaagaaggtcaagtgcacggccccacagtacgttgacttcgtcatgagctccgtgcagaagctggtgacggatgaggacgtgttccccacaaaatacggcagagaattccccagctcctttgagtccctggtgaggaagatctgcagacacctgttccacgtgctggcacacatctactgggcccacttcaaggagacgctggccctggagctgcacggacacttgaacacgctctacgtccacttcatcctctttgctcgggagttcaacctgctggaccccaaagagaccgccatcatggacgacctcaccgaggtgctatgcagcggggccggcggggtccacagtgggggcagtggggatggggccggcagcgggggcccgggagcacagaaccacgtgaaggagagatgagccccccgggccggacaggggcacacgtgtgcaaagagacggtggtgtgtgttctctcctgcatctgcgtgtgcacacatgtgctgggcacgcgtgtggtgaggtctgagagggccccgggctgcactggtgtgggctgcacaggcacagacgcagacggccccggccgtgtcctgtggccccctgtcggatggatgcgtgccgtttgtagagaagagcctttgggcccattcactcgttcagcagacacgcatgggactgatgctttgagttttcttctgtggggttttcctttctctggtctccgtgcagcccctgccctccctcgggtgctgctggcctcaaaggaggaactcgtggggggagggtgtgatttgcagacctgggtctctgctctgctctgggggtggggcttgctttcacagagaccctccttccctctcacccctcctctcccggcctcgccaggagtcttggctgttggcagctcagaggtgggggaggcctgtggtgtgaggtgccctgcacctgctcctgctcctgtcaccccttcctgctgcctcctccatgcccaaggaacacccatggtgcagtcctcaggcaaggccaggacggggctgaggccctgcgtggagatgctgcaccagcggaaggctgagacccgcttaccttagttcatctgttcactcgtaataaaaagaattctctcaggtc

SEQ ID NO: 155204 - DNA, 3391 bp, Homo sapiens
  Payload ID: 10510
  Gene Symbol: MOB3A
  Gene Name: MOB kinase activator 3A
  Uniprot ID: Q96BX8
  ENST ID: ENST00000357066
  CDS Start-End: 381-1034
gcggccgtgtccctccgcggcggctgcgaggcggtgcggcggctgaggcggccgaggcggccagttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagatttttttttttttggtcatactagagacaggggtctcgctgaactcctggcctccagtgatcctccatcctcggcctcccaaagtgctggaatcacaggggtgagccaccgcacccagccctctctcttcctcaatgcactctgcttcttccgttcttccgaaacattcagctgactgtatccagggcttcctggactcctgggaccccacgtcctgcaccccggcttctgactcatttcctaagggcccctttgtgtatcataaagggtttgatttttatagtcacatttacaaccatcttgagatttttattttttttgaacggagtctcccactgtcgcccagactggagtccagtggcacaatctcggctcactgcatcctccacctcctgggttcaagtgattctcctgcttcagcctcccaagtagctgggattacaggtgtgcgccaccacgcccaggaaattattgtagttttagtagagacaagatttcaccatgttggccaggctggtctcaaactcctgacttcaggtgatccgcctaccttggcctccaaaagtgctgggattacaggcatgagctactgcacccggcctaaccaggctggagtgcagtggtgggatctcggctcactgcaagctccgcctcccagattcacgccattctcctgcctcagcctccccagcagctgggactacaggcacccaccgtcacacccggctaatttttttgtattttagtagagacagggtttcaccgtgttagccaggatggtcttgatctcctgaccttgtgatccaccagcctcagcctcccaaagtgctgggattacaggcgtgagccactgtgcccggccaagaatttttttatcgataacatagtgagctctctgcctcttcggaacgatgtccactttgcttatgatcaacccaagcaggactcttctctccctggacgcctctcccctggtctggaatcttccagttctgccagaattggcctttcccagatgctgcaaacttccagttgaacccctttttctgtgtggcccctggggctgcgagaccaaaatccatgagttctgtgtaccctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcgg

SEQ ID NO: 155205 - DNA, 556 bp, Homo sapiens
  Payload ID: 10510
  Gene Symbol: MOB3A
  Gene Name: MOB kinase activator 3A
  ENST ID: ENST00000591236
  CDS Start-End: 370-556
gtgcgccttcgccgcccgggccccttaaagcccgcgggaccgagtctgggagacccctgcacgccgcttctgcgcggagccccgggccctttaaggaaatttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctg

SEQ ID NO: 155206 - DNA, 451 bp, Homo sapiens
  Payload ID: 10510
  Gene Symbol: MOB3A
  Gene Name: MOB kinase activator 3A
  ENST ID: ENST00000588048
  CDS Start-End: 402-451
agttgggtaccgggaggggcgaaggcgggcggcagaggcgatcaggagtcactgagaggggaggggaaattggaaaatgcagtcacagagcagaaaatcagtgctccaagccgcagctcatcctggggaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccg

SEQ ID NO: 155207 - DNA, 564 bp, Homo sapiens
  Payload ID: 10510
  Gene Symbol: MOB3A
  Gene Name: MOB kinase activator 3A
  ENST ID: ENST00000591326
  CDS Start-End: 376-564
gtcaccatgccagctctgccgggctgcagatgctggtttcagaagcgcctggcagctgcggagctctggggatgcggacttggctgggctaagatggatcggaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgtt

SEQ ID NO: 155208 - DNA, 1071 bp, Homo sapiens
  Payload ID: 10510
  Gene Symbol: MOB3A
  Gene Name: MOB kinase activator 3A
  Uniprot ID: Q96BX8
  ENST ID: ENST00000592280
  CDS Start-End: 160-813
tgtcgcctccagcaggtcatgattcccctgtgtatttcaggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaa

SEQ ID NO: 155209 - DNA, 730 bp, Homo sapiens
  Payload ID: 10510
  Gene Symbol: MOB3A
  Gene Name: MOB kinase activator 3A
  ENST ID: ENST00000589902
  CDS Start-End: 567-730
gcatgcgccaatggcccgtgcctgtgccaatggccggtgcccgctcctcggccggctcccgctgaggccccgccccgtgtcgcagccacggtgcaggctccgcccacaggccgcggccccggttgctaggcaacggagacctccgcccggcccggctcagggcatcccagggctgctgcccggaacttggctccgtgcgccttcgccgcccgggccccttaaagcccgcgggaccgagtctgggagacccctgcacgccgcttctgcgcggagccccgggccctttaaggaaaaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcga

SEQ ID NO: 155210 - DNA, 567 bp, Homo sapiens
  Payload ID: 10510
  Gene Symbol: MOB3A
  Gene Name: MOB kinase activator 3A
  ENST ID: ENST00000591638
  CDS Start-End: 338-567
aaaaaaaaaaaaaaaaaaagtgttgcagcaggggaatttgtcatttcacctttcatttctctagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgttcacgtggtggacttctttaaccgcgtcaacctcatctacgg

SEQ ID NO: 155211 - DNA, 564 bp, Homo sapiens
  Payload ID: 10510
  Gene Symbol: MOB3A
  Gene Name: MOB kinase activator 3A
  ENST ID: ENST00000586676
  CDS Start-End: 450-564
agcatcttccagccaagtatgagggctgggctgccaggccgggagccagtgttgtgcactgacctagaacatatggaactgacttctccactcagggcttgtctctcaggcgcctcccgtgctctggggcagcggtccccgaggcagtggcaggatgtggaaacctccggaaggaaaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgc

SEQ ID NO: 155212 - DNA, 6454 bp, Homo sapiens
  Payload ID: 10511
  Gene Symbol: MOB3B
  Gene Name: MOB kinase activator 3B
  Uniprot ID: Q86TA1
  ENST ID: ENST00000262244
  CDS Start-End: 426-1076
gtgcatgagggggctgctccggagcgacggcggctgcagctggagccaggcgctcgcccgtccgccggttggctcgccgggacctcgcgcaccggcggcagagtcccttgcgtggattggcaagcgacgccccacctgccccgagctcaccattttctttcgcgctggctgcagctgacccggcgaagggagccgaccgggccctgggctggaggtaaaaccccacggaaagaacatgaggttcccttggaaatcattcaagaggaagatggaaggggctgtttagaagagcttaaaagctacaggctgtaagactggggcctgagtgctggcagtggaaaacactgttgggctgtgatctctccctgaaaagttccaggtgccttttcgcttcctgcaaaagaaaggaagcgaaagagaagaccatgtccatagccctgaagcaggtattcaacaaggacaagaccttccgacccaagaggaaatttgaacctggcacacagaggtttgagctgcacaaacgggctcaggcatccctcaactcgggtgtggacctgaaggcggctgtgcagttgcccagtggggaggaccagaatgactgggtggcagtacatgtggtggacttcttcaatcggatcaacctcatctatggcaccatctgtgagttctgcaccgagcggacctgtcctgtgatgtcagggggccccaaatatgagtatcggtggcaggatgatctcaagtataagaagccaacagcgctgccagctccccagtacatgaaccttcttatggattggattgaggttcagatcaacaacgaggaaatatttccaacatgcgtgggtgttcccttcccaaagaacttccttcagatctgcaagaagatcctgtgccgccttttccgggtctttgtccacgtctatatccaccacttcgaccgggtcattgtgatgggtgcagaggcccatgtcaacacctgctacaaacacttctattactttgtcacagagatgaacctcatagaccgcaaggagctagagcctttgaaagaaatgacgagcaggatgtgtcactaatgctccacctcaccctttggaagaaaggaaagctgtttcctcctggtgccctgagcgggcaggaggtggaccaccctggctgaaatgacacacctactcccaggaacagcagaggtggaggcaagcagtgactcctgagagacattccccactcactttgtgtgctcttaaccttctgagtgctgctagcccagacctgtggacgaggcagaccacaacgtgaaagaaggaccagccccttgaccgttctggctggggaattgtccacgaggaagcctctgcacttccacacatggcacagttctgcctgtgacctgccgcctaagctttactggaattcaggttttgagactgagatgcgtgttcgtatttttccacttatctgtcttgtcagctggccgacttctctgtgattggttttttaagtgccgggtgaattttggacctctggatgtgcagcaagtttttatgcaataagccttcctttcaggtctctaaaagctcctgctctgatctgtggtttaacactgtgcagggctgtggagctctgagacacctgaacccctacccatcccctgcacctccctactctccctgccgaggcgtccatagcatttccctaataaatagttttatcagggacactccatggggtggcttgtctctgccccaaacagggtcttcacgttctaactgcagggaagagactggttactagcgtaaagctgacaagttaccagttcacctgatcagaatgtattttttataaccaccatcattccttgtctcttcagtggaagatattctttcctgtttcccagaagagagaaataaaagtcctaaataactaagaatgatcagcgggagcgttgggcatgattactgcagtgtttgttctttattaaagacagggagtcgtggctgtctctacataatactaacatttcagtgaaaaaagtacaattggttatttggtacgtgtagatttaacacccagacggctgacttgtaaccctccccactagccttctgagcatttaaacccagccgtcattctctccccactccacgctccccactcctctgccacgttatgttacggcacaaaattaatttctgcccctgtgattgggccacggttgccaaggtaacagtggagctggagctaacttccttctttcatcctttccaatttttctattccagaagacagtcagaataatgcattctgtactacatcctgccttttgaaacctaaatgagttttcgttgatgaaatgttgccttctctgattcattcacaaaactgtggtggttctgaccacctgtgacgaggggggtcataatacttccagtgatccttttaatttagcaaaatatttgtcggtggagggaagtagataagaatgtattagtgtattttaaagtaataatgattaaagaataactaaatgactctgattttgttttatcaatcataatgtgttaaagccctctgtggctgccacaaaagactagaatcatgaaatctttgtccaagctaagaaagggctgtctctgtgggtacagtggcattctctgttgacctaaccaagcagcctgaaccttgctttgtgtctcgtaaaggtcatctcacggaatccaattgctgctacctcaccatgttgctgtgccctggtcaacaataaacatacttttgtcccccttcctaagtaactttgagaggacaagataggcaaagttttttccctacatctcttttggccaaaagaatatctgaccatcacagagatccagagaacagaaacaagagcccctaagtcccagcctctgcaatacacagttaccagatgggaatgcagcacagtggcacagagaggtaactacggagcccatgccctggaggaactctgtagctgtgcatcatggaacgccacaggatttttacattaaaaagttgaatatgttcctgcatttcagcagtgcataatcgagcaggaggctggaatctggagacctttgttattcattctttttaaggttattttttattaactgtgcatatgaaatttccactcaatttaaaaatccaaatctttttaagcttcttggaagaatttcctcctgcttatattgttaattgcactaatgaactcttctagggtaaattctggcaaactaccctttttttttttttaatcacagaatattcctgttcccacagaactttggcacattctgaagaaaatctctgcagtcaatttttatctcctctgcttgactgcatctaactgttcatctctgttataaatggagcttcagccctctgggtcagagactgacaaccctccttcttcttcctaacctgtcctactctccttctttttctgctttcattttaattttgggaaattttaaagtaaaagtttcaaagttgaaagattatagtgagtacccttatgtcctttagtgcatcagttgttaatgttttgccttgttttcttttcttccttttttttttttaagagaaggggtctctccctattttacccaagctggccttgaaccccttgcctcaagtgagcttcaaccttagcctcctgagtagccaggactatggcatgtaccaccgcacctgcctcacattttctttctcactgtaaatacacattcttattcttgaaccttctgaaaataagttgcagacatcatgaaaatgtaaaatacttcatcatattctttcttttaataagagcattgtcctataaatctgcaatattttcacgcccatgaaactgaacactgatactgcataaatctaatatatgatccatattcaaaattctccagttgtccccaaaatatcctttatagctgtttatttttaaatccaggatccaatcaagaattatacgttatatgtagttgtcattctcttttgtttcctttaattgattagagttgcccttttgtgtgtgtctgagtggtgggtggtggggtggtgtttgtgtatgatgtgcagtgtgtgtgtgtgtggtgtgtctttcatgacactgacattattaaagagttcaggcaagtttgtggaatgtcccacaatctagacttttttactgattgtttcctcattacgagatacaggttacattttttttcccaagactgctacatgtgtgatgttgtttccttactactgcctcacctcaggaagcacataatgtctacttgtctcttttctgatattaggactgatcaggtgttgtctgcctgatccaatcattatcaagttccataattcattattaagctctgaaattcaggacacatacatttatagagtgtgaggctgtgcatacgtacattcatcccttaatgttctcaaggaggcccaggatccccaaaatattataagcattgcagtcagatgatatagcactagcaaagcattcatccctttccatataacaggagggaggggaagaaggaagtttccatgtgcaggcaatacgtgagagcatgggcaagtgaggatttgtatgctccctgtagccagaggtgaaatattcaacgcttttattttttctcccgtcttcaatgacctcccatttggacccatagtttatttatagagagcacacactccctaattgtcagatggtttttttgggaaaactcttagatagtacagtgagttgtgaccctccaaaggatcacaagtacataaacagatacaaagtatttatgtggtattaaaatttcatggtgatggtgcaagggagagatgattaggaagaaaatgtcttacacggctgtaattgagaaatactgatctagagtcatttcctgcttcttaaattgttcgttttctcttccctgggtattttctcatttccaaagacccagagtctcagagccaggttaagtggaagaaactttgagaggtttcttaatcaattccttctatctctcaaaccatgccagtaacttccttggtgaaaaaatctatactcctctcacagttcttcgggcatggaaattctatagcattctttggtataaccaacccactgaaccctccacaacatcttgaattccattcaactcgagctgaagtattctttttgagtttcagtatatcttttctagtgtcccacttttagaaaggtccaaagatgatatataataagtgaaaatacaattaatcagagctttatttgcatatccattaaatatctgaaggctattaccagttgtgcttcagcctcctttcccttgcaattctcccagggtggcatcctctacggagtcttgttgctccattgttgaccactgatgtaactcaacgtgaaaccttcccaaagctctccacatcactctctgttatggctgtgaccagcagtgaacatgaaaagaacttatttcatgccttctccaaactatattgtttctttgctaagtccagacctgctttttctacatttataggttttctattttaatcgccatgcaaaattctttatcatactcaatcattttggtttatcttcctgacttcttacctttaacatccctgttaaagattacactgttgttgtttcaaaaaaaaaaaaaaaaaaaccttaattggcaaaacattaagggacttgaatagaattacacttatctttttgtgctgatttatgtcaatccatcattctggttattgatggaagcaaattgcttcctatgttctctaaaccttatgtcccttccatactccatgagtaccacactgggagaaaacaaaagcaaaaagattgtgggaaaagtatagccattatctttgaggaaatgtgtaccaaggcacaatcattaaaaggagttggaggcatcatttggttgacactgttgtcattcttgttctgatcattttggaccttgaagaaattggtgattctctcctagaattagacaaacaaagtgtgtttggaaataatgattgttttcctgccttaaaaaatatattaacagaaagcttttataacaggctgtttccctctggacaggtattaattctgagtaagaattttcagtgactacataaggatttgtgtaacttatgaaggaagagtccatttctaatcaaataattcgcctgttttactagcttatagtgatctgatttcagaattttcctgtatcttttttacatacatcagaaaaagaaatgtttactatatttttggttccatttatgattgtattaagcatttgactataaggaaaactaacaattaaatcaattagaaaagcaacataaaattaaatgatatttaggaaatcagttatatgtgagcttgggtattcaaatgtcacaaataaaaagcatataaccatta

SEQ ID NO: 155213 - DNA, 2800 bp, Homo sapiens
  Payload ID: 10512
  Gene Symbol: MOB3C
  Gene Name: MOB kinase activator 3C
  ENST ID: ENST00000271139
  CDS Start-End: 58-864
agtgtgagggattttggaagcacttgccccaagcagagtttaaaatggagatggcaaatgaagcgcagaaatctctttgctctggaaactggggtcccaccctggggacttctttgggtgagaagtcgaagagtcgggatggatgagatgacctttcacatctggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcattgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaacgtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagca

SEQ ID NO: 155214 - DNA, 2822 bp, Homo sapiens
  Payload ID: 10512
  Gene Symbol: MOB3C
  Gene Name: MOB kinase activator 3C
  Uniprot ID: Q70IA8
  ENST ID: ENST00000319928
  CDS Start-End: 232-882
ccgtggccgcggcgtggcggggccggggcggagctggcgtcgcccggggcaggagggcagccgcggccggcaggacaggcagacggacaggctgacaggagagagaacaggcactgcgggacctgcaggagaaaggcgatcctgtggctgggaatgtgaccccacggccagaagaggacccggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcattgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaacgtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagcagcca

SEQ ID NO: 155215 - DNA, 5725 bp, Homo sapiens
  Payload ID: 10512
  Gene Symbol: MOB3C
  Gene Name: MOB kinase activator 3C
  Uniprot ID: Q70IA8
  ENST ID: ENST00000371940
  CDS Start-End: 3145-3795
tgtcaggcgggctcctctgggtcctacgaccttcctggccctgggagctggtttgaggttgcagggaagccgggggtgggcgtgggtggctgcgcgccgcgaggagagcgtggagtcttcgcctctactttttctcttcgacctctgtcctagagagagtcccaggatggattctgggttcaaactggggccatcctctggcccagatcctgggccaggcccaaggagtggtagatgtagcctagcagggggctaaatatcagaaacaggtagggtcagcctgctgtcttcatttgagaagcccagatccgcacccagggaacgagcaaggcactgccactccaggagtgaaaggatagccatcactgggaaatgggggctaggacggggaacggcagtggttcagggagagacagaggttctgtgacagatagaaactcagtgagggcatgggggtggggagtgaagggagttaaccctgtggctagaagagcacctgccctgcacccaccccctgagcttacattttcctggaaagagacccaggccttgaagttccacaggagtaaggtggaactctagctcactggtcaggacaccccagttgctgtgcggagtcagtgtgttggggacaggaagcaggttgggctgtttggtggagaagatgcttccactgtccctccactcccctcctcttctctgtctccaccagaccattgatgagccagtgcaggaaaatggtcttttactcttggtcatgagctgagccccaccttatcccagttcccagttctgcttgtaacttgctatgtggacacaggctcctcaagtcctctttttaggcctcagtttcctcatctgggcctcagtttccccatctgtacaagtgagttgggccagctgatctatcagggctattttaactctaagattctagtctaagctttccttaaagcctgaacactgactttgtgccaggccttgtcctaagctgggggtgggttggggatggagtggagactgcaatgaccaaaagcagcctctacccaaggagaaggagatctgagttcaggagaggaggctgtgggaggaggtagcagccaatctgaggatgtgtggtcaggcaggtggagggataagaaaacatgcagaggcaaaagagtgggggcgtgttcaggaatcaggaagaagcccagggtggttggtgtggggaggtgggaagtggggcaggaaaggtaggacaaggtgctgaatgccagggtgggggcctatttctaactgtcataaagggggccatgcaatgtggggagcccaggagccccgcctaattgcagtgtgagggattttggaagcacttgccccaagcagagtttaaaatggagatggcaaatgaagcgcagaaatctctttgctctggaaactggggtcccaccctggggacttctttgggtgagaagtcgaagagtcgggatggatgagatgacctttcacatctgtgagtttttttcaagagaacaagttcctgctgaatggcctgtttctactctccaagctgctctcattttaccagactgcccccatcctggcctgcctttgtgggttcaaggaaggacctttgtctcaaacagctccccagctagtttgacttcttgccagaagtaatacccctccccgaaatatgtgccatccctttgcttttacccaggtgtcacctggttcccaccctcccttccccaatcctgtcccagggttaccagagatgtgagaaaggacagtgctccagcgtcagaggtcaagcccaggctttggccataagcaagcctcagggtagggctaaaggctagagtcagggctcacacttgccagagcccaggtcagaggtcagccaggaaccagaatgcaattcttagcttatactcagccttagtgctcagtctaggggcaggggcagtgtgcttagtgggtggctaaattctagttttggtaggtacatgggtctgcatttcccagtagctcacacactcacagttgagatgagatgactcaggtcttagaaacctagctatagcagagtgacccaggacctggatgggctaaatccatggtgatacaggggtcacccagtaagccagtggtagagctgggactagaacccaggactcctgcctctgagcctagggccctgatcactgtctcccaaaatttgttctgaatctgggatccttaaattctaggaggcaaagtaaatttgcctgagctctagatgggccctcctgggtgcatctgactatactcttctacctcccagtgccaggcacatagtagttgctagaggaatgtctactgagtgtcaggtgcaacgggaggagccagtggcttgttcagatttggggctggaggaggctggcttgaggggaaggatctccagctgttgtcagaggaagcgacgccctcattggcctgccgccctccccctcctccagtgcttgcagccacactcagaagccgcccagctggcagcgggagggccctttcctctttcagggtgaaaaaaaaggaaaggacatttttggtagaaaagttccctgctgctccctgggaatccccggtggccggatggactacgggatatcccagaggaagccgaaagccacccccgacccccctccaccctgcccccagcacaatgctgcgaggctctcccacgttgcaccagctggccaagggggctcccagaggtcatctcgtccaagcccctgtctgctggtgggcctgcagggagcctctgcgacctctctcgtgaccaacagcaagtctgaggggcacctgtttagagcccaggcccagctctgcaatgaaagcagaaaagagacaaagcaagatgggaggactgtgggggcttagcaagggggactaacatagcctggaaagagggcggggcactggacctaggggctgaggacttagattccaggcagaggatgcagaggttgagcaaaggctgagaggtgacagggaaatgatgaattgggaagtcagagcccagatgataaggccttgaccgccagctcccctatgcccttgtccctggcagggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcattgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaacgtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaact

SEQ ID NO: 155216 - DNA, 2441 bp, Homo sapiens
  Payload ID: 10513
  Gene Symbol: MOAP1
  Gene Name: modulator of apoptosis 1
  Uniprot ID: Q96BY2
  ENST ID: ENST00000298894
  CDS Start-End: 395-1450
ccctcatgacgtcagatcgcccccgcccgccgcgcagcttccccgagcgagaccaaaacaggtggaatccgggctggagccggagctccggcggcgcgggtggcggcacgtccctccagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaatgagtagagcatgaaggtagaacagtctatatactcttgtgacacatacaatccctaccttgtgctgccaagtaactcatttttgtgcaattctcagtataagccctttgtcgtttctgtgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaatga

SEQ ID NO: 155217 - DNA, 2529 bp, Homo sapiens
  Payload ID: 10513
  Gene Symbol: MOAP1
  Gene Name: modulator of apoptosis 1
  Uniprot ID: Q96BY2
  ENST ID: ENST00000556883
  CDS Start-End: 486-1541
atgacgtcagatcgcccccgcccgccgcgcagcttccccgagcgagaccaaaacaggtggaatccgggctggagccggagctccggcggcgcgggtggcggcacgtccctccaggtgggtggctctctgggtctggcgactcagcgctcctcagccttgccccctggtgcccgctcgcgactgtcatcgccccatcacttctcgttgcagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaatgagtagagcatgaaggtagaacagtctatatactcttgtgacacatacaatccctaccttgtgctgccaagtaactcatttttgtgcaattctcagtataagccctttgtcgtttctgtgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaa

SEQ ID NO: 155218 - DNA, 2441 bp, Homo sapiens; identical to SEQ ID NO: 155216
  Payload ID: 10513
  Gene Symbol: MOAP1
  Gene Name: modulator of apoptosis 1
  Uniprot ID: Q96BY2
  ENST ID: ENST00000616515
  CDS Start-End: 395-1450

SEQ ID NO: 155219 - DNA, 2529 bp, Homo sapiens; identical to SEQ ID NO: 155217
  Payload ID: 10513
  Gene Symbol: MOAP1
  Gene Name: modulator of apoptosis 1
  Uniprot ID: Q96BY2
  ENST ID: ENST00000627896
  CDS Start-End: 486-1541

SEQ ID NO: 155220 - DNA, 3944 bp, Homo sapiens
  Payload ID: 10514
  Gene Symbol: MSN
  Gene Name: moesin
  Uniprot ID: P26038
  ENST ID: ENST00000360270
  CDS Start-End: 173-1906
gggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttca

SEQ ID NO: 155221 - DNA, 568 bp, Homo sapiens
  Payload ID: 10514
  Gene Symbol: MSN
  Gene Name: moesin
  ENST ID: ENST00000609672
  CDS Start-End: 258-568
actcatctggccacagcaggaagaagaggcgcccggaaaaccttagctcttggctatctcttccctgagcacaccctggccctggggcctgagatctctccatgcaggggcagccatgagctccgggggcagcagcaaggctggccacaccacccatcagccacctccagccccgccgctcaaccagccatcagtcccttaactgccagtgttcgtggaccatgcaaaacaaccaaatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatat

SEQ ID NO: 155222 - DNA, 3846 bp, Homo sapiens
  Payload ID: 10515
  Gene Symbol: MKX
  Gene Name: mohawk homeobox
  Uniprot ID: Q8IYA7
  ENST ID: ENST00000375790
  CDS Start-End: 434-1492
gactcggcgggcccggggctccccggcagcggctcctctgctaggggttaacagcagcccccgcggccgggcgggcgcggacgcttcctctccacccgcccgggaacgtggataccgcgcccgcaggatgttcgccggctgggaccggcagtcaggaaacatgagaaggcctcgctattcctgttcccgggcggcgcgcgccgggctgggtaaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagacactctggaaaacggatccaataagggtgaaagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttttaagagcttgttgcttttcagatccaatggatgttctttccggtgttttcatcaaccctcatcctaagagccgaagcagggatgaaaatgactctctcccaaacctcttcttatttttaattatcccaaatatatcatttagttgcttctataaaagacatataaattataaaaaactcattttaatcaaaaatattaacttattttatgttactcaaactatgcataaaacatctgcattaccattacagtaagtgccttgcttcccgacaataagctccaacgtgggcatagttgaacaagctatgcctcaaaatgccaacgccatatgcttattagcctgtgtgcatcattccagacgggcctaatcattccaggactgaaaccagaatcgctgaaagcccttgaaatacattcaataattcatatgttaaaacttggatatctgttcagcccaaatgaaatcttccttttaaaaaacgtctacattattgaaaattgttcaatgtgcttttcagagtgacggtgagaattttatgcatgtatcttgcctgcatatttgatatgttacaaacttccaaaattcaaggtgcagcgatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcg

SEQ ID NO: 155223 - DNA, 3638 bp, Homo sapiens
  Payload ID: 10515
  Gene Symbol: MKX
  Gene Name: mohawk homeobox
  Uniprot ID: Q8IYA7
  ENST ID: ENST00000419761
  CDS Start-End: 226-1284
aaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagacactctggaaaacggatccaataagggtgaaagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttttaagagcttgttgcttttcagatccaatggatgttctttccggtgttttcatcaaccctcatcctaagagccgaagcagggatgaaaatgactctctcccaaacctcttcttatttttaattatcccaaatatatcatttagttgcttctataaaagacatataaattataaaaaactcattttaatcaaaaatattaacttattttatgttactcaaactatgcataaaacatctgcattaccattacagtaagtgccttgcttcccgacaataagctccaacgtgggcatagttgaacaagctatgcctcaaaatgccaacgccatatgcttattagcctgtgtgcatcattccagacgggcctaatcattccaggactgaaaccagaatcgctgaaagcccttgaaatacattcaataattcatatgttaaaacttggatatctgttcagcccaaatgaaatcttccttttaaaaaacgtctacattattgaaaattgttcaatgtgcttttcagagtgacggtgagaattttatgcatgtatcttgcctgcatatttgatatgttacaaacttccaaaattcaaggtgcagcgatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcg

SEQ ID NO: 155224 - DNA, 1002 bp, Homo sapiens
  Payload ID: 10515
  Gene Symbol: MKX
  Gene Name: mohawk homeobox
  ENST ID: ENST00000460919
  CDS Start-End: 131-1002
ctgagcactctcagccagtaagtaacgagatgcaccttcctctcctagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagtggaaaacttaggttctttgagtgaggactcctg

SEQ ID NO: 155225 - DNA, 431 bp, Homo sapiens
  Payload ID: 10515
  Gene Symbol: MKX
  Gene Name: mohawk homeobox
  ENST ID: ENST00000561227
  CDS Start-End: 258-431
aaggtctggtggagaggcgctcgggtagcggccaaggctggcccaagggtctgcgcggagcttgggagcccacctggccgcgcctcctttgctttaaaattattcgccggcgttgggggagggggacacttctgcagggagtgacctccccggccacagtctggagtgaatcgggaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgaga

SEQ ID NO: 155226 - DNA, 1725 bp, Homo sapiens
  Payload ID: 10516
  Gene Symbol: MOK
  Gene Name: MOK protein kinase
  ENST ID: ENST00000193029
  CDS Start-End: 1-1257
attaaaaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttacagtattgcattttaatgtt

SEQ ID NO: 155227 - DNA, 1940 bp, Homo sapiens
  Payload ID: 10516
  Gene Symbol: MOK
  Gene Name: MOK protein kinase
  Uniprot ID: Q9UQ07
  ENST ID: ENST00000361847
  CDS Start-End: 233-1492
atcttgcgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 155228 - DNA, 574 bp, Homo sapiens
  Payload ID: 10516
  Gene Symbol: MOK
  Gene Name: MOK protein kinase
  ENST ID: ENST00000524207
  CDS Start-End: 168-302
acacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagactagggaattgaaattcggagagatcaagttccccacctggcccgttgctacccaacctacacgtcgtggagctgactctgagcccagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatg

SEQ ID NO: 155229 - DNA, 580 bp, Homo sapiens
  Payload ID: 10516
  Gene Symbol: MOK
  Gene Name: MOK protein kinase
  ENST ID: ENST00000518482
  CDS Start-End: 187-366
ggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagggagaagatacccattatcagaaaaaaaaattatgcactatatgtaccagttatgtaagtccctggatcatattcacagaaatggaatatttcacagagatgtaaaaccagaaaatatactaataaaggttgtaaaaaatggtttatttaataaatgccatcaacataactgactgcacctggaagaaaataattgaaagcaccattttcacaccgcagacaaaaatgaaccctattcagacggccgttcaaaccttctagagggaaatgtg

SEQ ID NO: 155230 - DNA, 1539 bp, Homo sapiens
  Payload ID: 10516
  Gene Symbol: MOK
  Gene Name: MOK protein kinase
  Uniprot ID: Q9UQ07
  ENST ID: ENST00000524214
  CDS Start-End: 218-1387
aggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctg

SEQ ID NO: 155231 - DNA, 617 bp, Homo sapiens
  Payload ID: 10516
  Gene Symbol: MOK
  Gene Name: MOK protein kinase
  ENST ID: ENST00000520238
  CDS Start-End: 175-309
gacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagactagggaattgaaattcggagagatcaagttccccacctggcccgttgctacccaacctacacgtcgtggagctgactctgagcccagtgacggggtttcactggacaggctcgtcttgaactcctgacctcaggtgatccacccgcttcagcctcccaaagtgctgggattataggtgtgagcaactgcacctggccagtttatgcctctttaatgctgagcaacattcattacaatcttgacagaaaatctggttctcttgcactaatatgtgaacttatggacatgaatatttatgagctaatacgaggtacgtaga

SEQ ID NO: 155232 - DNA, 2736 bp, Homo sapiens
  Payload ID: 10516
  Gene Symbol: MOK
  Gene Name: MOK protein kinase
  ENST ID: ENST00000521766
  CDS Start-End: 201-380
gttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtaagtattgtgttctgagagtggatgtggacccactcccctgctaggacctgcagcagggcaagcccctccctgtgcctccctcaaacccctctcaggagctcctttggctgactacaggggttcaagttcacttgagggccagtgagtggctgctcagacagagcccatcactttaagtggtctcaaaggtgagctcttccttgagcatcacagaaagatttgtcacaggctttctgagggctggggagtcaggctgtgttccctgagtaatttaaacaggacttagaagcctttgggtggaaacgttccccaagcacagagcataggtggtgagggctttctgcagccctccacagccctgctggcgggaccgacgcctggaagaggtgttcccggactcttagggtcattctggtgaagctgaggctgggagttgggacttcccagggagggcctgtgggctgaggggcaagtagcacccagcggcccccacatcccagggagggagaaggtggcaaccattttggactcttctttttttgttaaattttatttcattcttctcatgtgggaaggtgatattaatcttttataggaaaggtagttttcttacatttttagcataacagatccccccctttataatagactatttttaaatagatttttttaagagcagttttaggtttccatagagccctgtccccatgtgcacacagcctcccctgtcgtcagcacctgcctcgagtggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttacagtattgcatttt

SEQ ID NO: 155233 - DNA, 549 bp, Homo sapiens
  Payload ID: 10516
  Gene Symbol: MOK
  Gene Name: MOK protein kinase
  ENST ID: ENST00000522093
  CDS Start-End: 187-321
ggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagactagggaattgaaattcggagagatcaagttccccacctggcccgttgctacccaacctacacgtcgtggagctgactctgagcccagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggac

SEQ ID NO: 155234 - DNA, 1890 bp, Homo sapiens
  Payload ID: 10516
  Gene Symbol: MOK
  Gene Name: MOK protein kinase
  Uniprot ID: Q9UQ07
  ENST ID: ENST00000522874
  CDS Start-End: 184-1440
tgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttaca

SEQ ID NO: 155235 - DNA, 837 bp, Homo sapiens
  Payload ID: 10516
  Gene Symbol: MOK
  Gene Name: MOK protein kinase
  ENST ID: ENST00000517537
  CDS Start-End: 167-622
cacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaaggttgtaaaaaatggtttatttaataaatgccatcaacataactgactgcacctggaagaaaataattgaaagcaccattttcacaccgcagacaaaaatgaaccctattcagacggccgttcaaaccttctagagggaaatgtggcagaggcaggatttgagctcaggatgtcctgaaattaggggactttggctcctgccggagtgtctattccaagcagccgtacacggaatacatctccacccgctggtaccgggcc

SEQ ID NO: 155236 - DNA, 610 bp, Homo sapiens
  Payload ID: 10516
  Gene Symbol: MOK
  Gene Name: MOK protein kinase
  ENST ID: ENST00000518399
  CDS Start-End: 211-390
agctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagggagaagatacccattatcagaaaaaaaaattatgcactatatgtaccagttatgtaagtccctggatcatattcacagaaatggaatatttcacagagatgtaaaaccagaaaatatactaataaaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgcc

SEQ ID NO: 155237 - DNA, 917 bp, Homo sapiens
  Payload ID: 10516
  Gene Symbol: MOK
  Gene Name: MOK protein kinase
  ENST ID: ENST00000519058
  CDS Start-End: 316-693
ctgtaagggtaacgattaggcagacggctaaagtgagggagacttttggctggtattccaattggaaggagttacactatataatcccactgcaaacaataggtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgc

SEQ ID NO: 155238 - DNA, 559 bp, Homo sapiens
  Payload ID: 10516
  Gene Symbol: MOK
  Gene Name: MOK protein kinase
  ENST ID: ENST00000521937
  CDS Start-End: 1-340
gaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctg

SEQ ID NO: 155239 - DNA, 770 bp, Homo sapiens
  Payload ID: 10516
  Gene Symbol: MOK
  Gene Name: MOK protein kinase
  ENST ID: ENST00000521388
  CDS Start-End: 170-349
ggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagggagaagatacccattatcagaaaaaaaaattatgcactatatgtaccagttatgtaagtccctggatcatattcacagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacaggatcaggaatacctctactaacaaccaatttgtccccacaatgcctctccctcctgcacgcaatggtggcctatgatcccgatgagagaatcgccgcccaccaggccctgcagcaccc

SEQ ID NO: 155240 - DNA, 1165 bp, Homo sapiens
  Payload ID: 10516
  Gene Symbol: MOK
  Gene Name: MOK protein kinase
  ENST ID: ENST00000524370
  CDS Start-End: 373-660
ctgtgactggtgctggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttaca

SEQ ID NO: 155241 - DNA, 1230 bp, Homo sapiens
  Payload ID: 10516
  Gene Symbol: MOK
  Gene Name: MOK protein kinase
  ENST ID: ENST00000517966
  CDS Start-End: 430-717
attcctgagtctgtgactggtgctggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgatggtggcgtgggaatgaagaatgtgatatacatctttggagtctgttctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttacagtattgca

SEQ ID NO: 155242 - DNA, 2041 bp, Homo sapiens
  Payload ID: 10516
  Gene Symbol: MOK
  Gene Name: MOK protein kinase
  ENST ID: ENST00000559138
  CDS Start-End: 369-512
gactggtgctggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaacccagaacggaagcgaggatgaggcctcagccgtcctcctccccattcaaacacgttcatccctcaaccctctgctgagcacctgcatgctgcccggccgcagtgtcacccttcttgtgtgagcctaccctcatccacccacctcaccctcctgaccttaaagaagacaccgggcagaagcacaggggagcccagtcacaccccacactggcgggggcaggccttgcagggagaagcagtaagcagccatctccatcagccatttccatctggcactcagacgtgcacgtcttcgtgtgacaggcggcagcagtgcgaccgtgacctcccatctgctctgctgtccccacacctgcggtgcagccagcctgccacaaggcagctagagtccagctagacccacccctggcacggccgacctcttcctggcttcttctgggcctaatccccgtgcattctccaacgccagaagtgtaagaaagtgcaaggcaacaagtgagaagagcaaacccaaatcgtaccagggaagctagtctttccagggcacctgagtgagggcatgaccagccttgacgctgcctcgctaccatctgcccagggcctgctgaatgcttgagtccatggtgacagtggtgggaacagttacgaggcagttagattttggaagtcatgttggcccacttggctacagagcagtcttaggaacagcaccataaaaataaagacttattcctgacacacatgcatctagagtaaactggggcgtatctgacagcgttagtacagtgatggccaaatgcaaactgcattccagaaccagcgaagggtgacagactgggctgaggcagagctaggactaaccatctcgagtgatgccatctcggggccaacaaaagttttggacacggctggatcatctgaccaaactgctcaaatctttacacaattattgtcctggtattaaactttcacctgccacttccaacaaacaggagacagaataaggagatgaccaggaagatggctggattaagaattctagacttggccgggtgcggtggctcacacctgtaatcctagcatcttgggaggctgaggcaggaggatcgcttgagcccaggagtttgagaccagcctaggcaacataaggagaccccatctctacaaaatatcaaaaaattacccaggtatggtggcacacacgtgtgattccagctactcgggaggctgagatgggaggatcacttgaacccaggaggttggggctacaatgagctatgatcgcaccacttcattccagcctggatgacagaagactcactccatagttcatggccccgtgatccagagtccctgctggcgccttcgagtggggcaggctgagaactcaagctgtaactaatgtctcctccgaagaaaactaaaccgagggctgagctgatgtgaagttttccgtggctgcattcatacaaatggtgaaaatgtagcatacctcccctcaaaagcctgaaagtaaagacatgcccccaatttaatgtgatgaattagagaaataggtttcagacacttcatggtttaaagtctcacaaaataaagctttcgaagga

SEQ ID NO: 155243 - DNA, 643 bp, Homo sapiens
  Payload ID: 10516
  Gene Symbol: MOK
  Gene Name: MOK protein kinase
  ENST ID: ENST00000559838
  CDS Start-End: 1-520
aaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaagactcactccatagttcatggccccgtgatccagagtccctgctggcgccttcgagtggggcaggctgagaactcaagctgtaactaatgtctcctccgaagaaaactaaaccgagggctgagctgatgtgaagttt

SEQ ID NO: 155244 - DNA, 1114 bp, Homo sapiens
  Payload ID: 10516
  Gene Symbol: MOK
  Gene Name: MOK protein kinase
  ENST ID: ENST00000523231
  CDS Start-End: 322-609
ggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgtctgcagcccctctttcctggagtaaatgaactggaccaaatctcaaaaatccacgatgtcatcggcacacccgctcagaagatcctcaccaagttcaaacaggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttaca

SEQ ID NO: 155245 - DNA, 608 bp, Homo sapiens
  Payload ID: 10516
  Gene Symbol: MOK
  Gene Name: MOK protein kinase
  ENST ID: ENST00000522537
  CDS Start-End: 320-608
atgctgttccggtggaggattaggatgttgtcgaggaggggagaaatcggtgggatcaaagaaggagaagtcgtccgctggggctattgggatgaggggagcaggagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctga

SEQ ID NO: 155246 - DNA, 568 bp, Homo sapiens
  Payload ID: 10516
  Gene Symbol: MOK
  Gene Name: MOK protein kinase
  ENST ID: ENST00000561150
  CDS Start-End: 236-379
actctttccttttcttccggaaggagggtagaagacaaaataatatagagatcatgccaatctgcagcccctctttcctggagtaaatgaactggaccaaatctcaaaaatccacgatgtcatcggcacacccgctcagaagatcctcaccaagttcaaacaggatcaggaatacctctactaacaaccaatttgtccccacaatgcctctccctcctgcacgcaatggtggcctatgatcccgatgagagaatcgccgcccaccaggccctgcagcacccctacttccaagaacagagaacccagaacggaagcgaggatgaggcctcagccgtcctcctccccattcaaacacgttcatccctcaaccctctgctgagcacctgcatgctgcccggccgcagtgtcacccttcttgtgtgagcctaccctcatccacccacctcaccctcctgaccttaaagaagacaccgggcagaagcacaggggagcccagtcacaccccacactggcgggggcaggccttgcagggagaagcagtaagcagccatctccatcagccatttcc

SEQ ID NO: 155247 - DNA, 1883 bp, Homo sapiens
  Payload ID: 10516
  Gene Symbol: MOK
  Gene Name: MOK protein kinase
  ENST ID: ENST00000522867
  CDS Start-End: 1138-1425
ctgcaagccacactctttccttttcttccggaaggagggtagaagacaaaataatatagagatcatgccaatctgcagcccctctttcctggagtaaatgaactggaccaaatctcaaaaatccacgatgtcatcggcacacccgctcagaagatcctcaccaagttcaaacagtaagtattgtgttctgagagtggatgtggacccactcccctgctaggacctgcagcagggcaagcccctccctgtgcctccctcaaacccctctcaggagctcctttggctgactacaggggttcaagttcacttgagggccagtgagtggctgctcagacagagcccatcactttaagtggtctcaaaggtgagctcttccttgagcatcacagaaagatttccctccacagccctgctggcgggaccgacgcctggaagaggtgttcccggactcttagggtcattctggtgaagctgaggctgggagttgggacttcccagggagggcctgtgggctgaggggcaagtagcacccagcggcccccacatcccagggagggagaaggtggcaaccattttggactcttctttttttgttaaattttatttcattcttctcatgtgggaaggtgatattaatcttttataggaaaggtagttttcttacatttttagcataacagatccccccctttataatagactatttttaaatagatttttttaagagcagttttaggtttccatagagccctgtccccatgtgcacacagcctcccctgtcgtcagcacctgcctcgagtggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtga

SEQ ID NO: 155248 - DNA, 796 bp, Homo sapiens
  Payload ID: 10516
  Gene Symbol: MOK
  Gene Name: MOK protein kinase
  ENST ID: ENST00000522534
  CDS Start-End: 342-719
gtgcggcttgaaggagttggtaaataagggggtggttagtgatagggtcactttggcagtaaggaatctcctctcttgccagatggtggcgtgggaatgaagaatgtgatatacatctttggagtctgttctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcga

SEQ ID NO: 155249 - DNA, 735 bp, Homo sapiens
  Payload ID: 10516
  Gene Symbol: MOK
  Gene Name: MOK protein kinase
  ENST ID: ENST00000562292
  CDS Start-End: 188-457
cggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggttttggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatg

SEQ ID NO: 155250 - DNA, 6160 bp, Homo sapiens
  Payload ID: 10517
  Gene Symbol: MOCOS
  Gene Name: molybdenum cofactor sulfurase
  Uniprot ID: Q96EN8
  ENST ID: ENST00000261326
  CDS Start-End: 22-2688
ctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgcggaacgtgaccatggctataaatgtcatatccaccccggtcaggccagaggacctgtggtctgcagaggaacgtagtgcttcagccagcaacccagactgccagctgccgcatctcttctgctacccagctcagagtaacttttctggagtcagataccccctgtcctggatagaagaggtcaagtctgggcggttgcaccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacgtggccctgtcctctctccagtaccccaatggagcccctgtggtgcggatttacagcgattctgagttcagcagccctgaggttcagggcccaatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtcatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcaggtgctccctgtgttgaaagagaatgtggaaggtcatgatttacctgcatctgagaaacaccaggatgttacctcctaaaaaaaatttttagcataaagtttctcttttacagtgatctctattattgttaagatctgcaacttggttcagtagaacttgatgttttgaataaggagagctctttttctttagaggcagggaatgctctcacctgcttccttctgcctttgacttctcaccctgcaaatttgcactggctgtgctcaggagagcacttctgaggcctcaggaacgaatgctgcacccacatccagtgaggctcctgtaggtatttgaagtataatcacttgtaatcagatgaaatttttaatgaagttcactgggaagattgaacttactgcgggtccctattttgccattttctcacattgttactttgtttttagagagcatctttggatctctccaacccgtttgtagtgaggaagggagtctatgcccagtgatcctgggtatgagaaggtgctcctctcctcccatgtacatgatggtgtgggtttatgctcaggggcccagagggtaacttgtgaccacattccttgaggggagtttctaccagaatatttatattctgagcaaaggcacaggccagcaattcctttcctgttgcttcccatccctggcctccgtcctcatcccccactgagttgatgcactgaggatggctcacgagcctgaagttacactcagtgatggctgtgcttatgcaggttgtcatcctcccctccacaagcccacaggatggtgttggtccatcacccgagagcctccaaatcctatcgagggaggaactttggcattcaggaatcctgtctgtatcatctttgaccactgctcctgcagcctccagatgaaaatgtccagtgaggaaatctcattctctaatgaagttacccatcccgctgagtttctaagaagtttctccctgtgcggagcttgtgtgtgccttatctgcttctgcatgacttccagcctggggtcttaccctgtcctctggagcaatgcagagtgagtacatccactccacattcattctgctggcgtccttctgaagcctgctgtccatgtgtgaacccagtcccttcatcatcttccccctggatggttgtatttttccagtcacttctcccccaaatgtctgcctgctgcagcccactgcatcttttgaaagcctgtgccaccccatctctcctgctgctcagttggagagcaggctccaggctcaggcttccctaatgtatctgttcagagcctgtgggattcagggtcagtttgtttcattatcacatttgtaggactttgtgttgttcccagcactaggtgagatttgaaagatgaggtgtgctctgttctcaaggattgttgagatggagcctaatgattgcacactcacgtgctgtgaagagttaagggtaaaaagtacaactctgactctggttcctgagatcaccgaaagaagaggcaaatgaagttaggtggggtggggtggggtttattgttttgaactgtttattaaaaacgcaacctcttcaaagactcagcactgccacatcatatgagtggacttgtcctcatcagctaactgataggagaacaatgccctaaagtaatggatttatccacctactcaggccagtttcatgcaggagggaactttccagatggcacattgccccatttccaagaccttccgctgacaaatgcatcatattaattatgatggaaaacaagtaagaaggcatgctctacaaaaattaggtcacttgcccaggtgcggtggctcacacctgtaattccagcactttgggaggctgacgtgggcagatcatgaggtcaggagatcgagaccatcctggctaacacggtgaaaccccgtctctactaaaatacaaaaaattagctgggcatggtggcatgcacctgtagtcccagctacttgggaggctgaggcaggggaatcgcttgaacccgggaggcggaggttgcagtgagccgagatcatgccactgcacaccggcctggtgacagagcaagactccatctcaaaaaaaaaaaaaaaaaaattaggtcacttttgtcatcaagaatatgtttttcttatccacgtctatgtcaccttttgcagtagatactttcatgactgatttcaggctttttgtttttttgagacagggtctcactctgtcacccaggctggagtgcagtggcatgatcacagatcattgcagccttgacctcttgggctcaagcgattcccctgcctcagcctcccaagtagctgggactacaggcacacatcaccacatccagctaattttttttttcttttttttctttttggtagagatggcatctcactttgttgcccaggctagttttgaattcctgggctcaagccatcctcccgccacagcctcccaaagttctgggattacaagtgtgagccactgtgcccagcttttgatttcagacattttaatgcagatcctctcctttacagcactattatttggttatctacttataattactgatttaacattgatctgttttcactagactgtaagctccatgaggacaagtcctgtgccagtatatctctagtgtcagcagacaatactcaaaatttgttgacagactatttaaagctgcccctatttttatcattaattgattgaatattaattaaatatattttattaatttaaaatgaattttaaatgcattttttctttagtgtctaccttcaatatttcttgtatgaagtttcagctaaaaatgtactttgtgtatctgtagagtggcttcatattcagagtttatggacatttatgattttatgtcccctccttggttcttatctcctggagttcagccttatgtgcttctcaaagtgtataacaaaatcaaagacaatgtcatgtcccttgaatttaattctaacaccaaaccttggtgttagagtcacaaaaagtccttttttaaaaaaacttggtgagaacagacaataacttgtctttctgggcattcgcgtcatggtccttttagccagaagagaggttttcttttgcatagtttggtgagcatcaagaatcctttaaggagggtggcggtgctgacttctccccattgagagtcagcctcatcccctcctcagccttgtggatggagaagaacaggcagtgatatacattttctgctgttgaaagatgtccgcttatccttctctttcagtgaaaagttgcttttttattcaatatgtactgaacaggttctagagtttcagaaacaaaagaaacagaaccaacatttatagatctcactatagaggcatcactaattggggaaagacagactaggtaatagtcagatgtgatatagtatgtttaagctataggatggcaggtgcatgagtgttggttgtattattctttatttttttgtatgacttatgatattcatgataattaaaacgttttggaacaattca

SEQ ID NO: 155251 - DNA, 2747 bp, Homo sapiens
  Payload ID: 10518
  Gene Symbol: MOCS1
  Gene Name: molybdenum cofactor synthesis 1
  Uniprot ID: Q9NZB8
  ENST ID: ENST00000340692
  CDS Start-End: 5-1915
cttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcgagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttg

SEQ ID NO: 155252 - DNA, 1527 bp, Homo sapiens
  Payload ID: 10518
  Gene Symbol: MOCS1
  Gene Name: molybdenum cofactor synthesis 1
  Uniprot ID: Q9NZB8
  ENST ID: ENST00000373181
  CDS Start-End: 269-1114
tccaatttcacctggctcctggggctgtcacttccctttgcttcatgtttataaaatgagaggactgggccagcccatcataagatgggggagggcacagaaacttgtcttgaggagactctaaggggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcagagtgagaaggctgagctctggaacaacgtatttgtgtcctctgtcaacagttgaaccaaattctgcttttctgaagatcaaatgtatcttgaacagcttccatagtccttttgtttccagagcactgagacccaacatgtgacctggggccagcagcatcacctaggaaattatgagaaatacagactctcagacccacaggatcagaagctgcattttaacaagactcatctttacaagactccaggtgactcatgcacaaattaaagagacatttttctaaagctcccagctgattcagaagctgctggtccatgtaccgcactttgagtagcacttaacaggactataaaattgtaaatttggaaatcatcttcccccaccgtagtggcaacaaaacgttctttgtcatccttaa

SEQ ID NO: 155253 - DNA, 4256 bp, Homo sapiens
  Payload ID: 10518
  Gene Symbol: MOCS1
  Gene Name: molybdenum cofactor synthesis 1
  Uniprot ID: Q9NZB8
  ENST ID: ENST00000373186
  CDS Start-End: 139-1296
gccagaaatcttcccagtagagatcaccatccgcccccgacccccaagctgaatacttaaggggtgggtccttcccatcaagctgatttctcaacgagagggacaatcccagcttccccaacattgcagagcccaaacatgtggaagagttggaagctccgcacagatgtcagagtaagggagggggcaggcggttctccttgtgcctcttcccagcccggtagcaggggcccatgcttcctccctggtctgtcctcgcaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagcacactctcagcccaccccagatcccctcataggaagaaggcacaagtttaaaggcagactgggtagggatggtatgaatttaatattttttagtattacaatatattcttataaaaaaggtgcaagtgaaaaaggacactgtagattatgtccattagcctcatttgtcatctgaggcagctggtgagaacagccttggcgtgaaggcatccctggtagaagtcgggggagatagatagtcacagttccccagttggtggaaatgggatgggagtagggagaggctggaacagacccttccccattcacctggagaattttctcctcccactgccctaaacactttatttccatcacaggggagaaatgctgctgagaaggttgtgtttgttaggttgatgacgaattttacattggccacaaaattagctagagaaacttatctaaaggtggcaggagcagtggggagggcatgaagaaagcaagaccaagaaacaacctattaaggaccagctcagccaccccgactgggcaccagccccttcttactcagttgagtatgagtccatggtccaaggcactgttggagatctggctacagtggcatctagcaccagagccactggccagatgtagaaaataaatagaaaaatatctttcttttagagtgagaaggctgagctctggaacaacgtatttgtgtcctctgtcaacagttgaaccaaattctgcttttctgaagatcaaatgtatcttgaacagct

SEQ ID NO: 155254 - DNA, 3358 bp, Homo sapiens
  Payload ID: 10518
  Gene Symbol: MOCS1
  Gene Name: molybdenum cofactor synthesis 1
  Uniprot ID: Q9NZB8
  ENST ID: ENST00000373188
  CDS Start-End: 135-1292
gcgtcctcgcctattggctgcgcgggtcccgccctccccctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtgacccatcaagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctgg

SEQ ID NO: 155255 - DNA, 2852 bp, Homo sapiens
  Payload ID: 10518
  Gene Symbol: MOCS1
  Gene Name: molybdenum cofactor synthesis 1
  Uniprot ID: Q9NZB8
  ENST ID: ENST00000373195
  CDS Start-End: 215-1816
cttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcagagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatag

SEQ ID NO: 155256 - DNA, 1071 bp, Homo sapiens
  Payload ID: 10518
  Gene Symbol: MOCS1
  Gene Name: molybdenum cofactor synthesis 1
  Uniprot ID: Q9NZB8
  ENST ID: ENST00000432280
  CDS Start-End: 1-1071
atgtggaagagttggaagctccgcacagatgtcagagaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcggtgggtga

SEQ ID NO: 155257 - DNA, 1920 bp, Homo sapiens
  Payload ID: 10518
  Gene Symbol: MOCS1
  Gene Name: molybdenum cofactor synthesis 1
  Uniprot ID: Q9NZB8
  ENST ID: ENST00000425303
  CDS Start-End: 10-1920
agcccaaacatgtggaagagttggaagctccgcacagatgtcagagtaagggagggggcaggcggttctccttgtgcctcttcccagcccggtagcaggggcccatgcttcctccctggtctgtcctcgcaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcaggcatgttcagtatttcccagatgaagaaccggcccatgatcctcatcgagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttag

SEQ ID NO: 155258 - DNA, 566 bp, Homo sapiens
  Payload ID: 10518
  Gene Symbol: MOCS1
  Gene Name: molybdenum cofactor synthesis 1
  ENST ID: ENST00000487924
  CDS Start-End: 43-339
gtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtgagtcaccttcctgggccctctctgggctggtgtccatctgctgaagcagcccttgaaatttccctgtgcctggaaatcctcctgtgtcctccagttctgctttctaacttcttcacctgctaccccttgcttaccaggccaggtcagtactgcatgcccgaggagggggtcccgctgacccccaaagccaacctgctgaccacagaggagatcctgaccctcgcccggctctttgtgaaggaaggcatcgacaagatccggctcacaggtg

SEQ ID NO: 155259 - DNA, 3568 bp, Homo sapiens
  Payload ID: 10519
  Gene Symbol: MOCS2
  Gene Name: molybdenum cofactor synthesis 2
  Uniprot ID: O96033
  ENST ID: ENST00000361377
  CDS Start-End: 43-309
gcgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaagagtattttctttttttttaaattgcctaaaatagttctcattatggagatttctgggatttcagaatctataatcttaccagaaaactttttgttgttttttattagttgttaattttgtatcaatatacaaatcagcacaaaattgtcataaagctaactagcaacaaggtggtttgtgttgaaatgtttaggtaaacaatgccccaatttttaactggttaagctttatagtattttgatagacttgtacatataagtcccatatagttcttaaatttttttttccagctttatttaggtatacttgacaaaaattgtatgtatttaaagtatacaatgtgatttttgatacacatatacattgtgaggtgattaccataatccaactaattaacatattcctcagctcacatagtcccctcttctgtgtggtgagaatatttaaggtctactctcagcaaatttcaggtaaacacatagctcataaaataataaaatacaggcaaaatttgggcagtcggcatcatcacaaaatttgcattatgcatattaagaacaaaagctatactttcagacacttagattgaaggatttttttcttatgtctgggacaaataagaaacgtagtaatcctatttgttatatgtagtgaaaacatcttttacctaaggaacccatttattcaacaaatatttattgaatgcctgttttgtgccaggcacccacccagtgatctttttctgccaacctaaaataccttgaggaacactctgcatcttatctgtggctgggacccataggacagccacactgactttaggaatcacctggttacatcagttgatgcttgttcattagtccgtctggagagattgggccagaaggatactggaagggcagacaaaccctccgcctacttcctctgccgggttcgggttgcctgtttggtctcagccttaccttcacagttcagtgtcactctggcttgccatcgagcttccgcctgtccccattggagagaaggggtgggtgttggctgttgcattatatctaaaagcacattatcatggggttactgggtcactggacatttctaggattttggacataggttgttaaatggatgttatgtcatatgcaatgttgataggtatatgtggatttcaagactttcctacttagatatttctttagaagttccttattgagggtaatgatgtttttaaagaacatagaacattctttatgttttaaaagaatcatgccttcattaagtaggctttattctaagtttggaactgagactgttatgcttttaaagtctccaacagagaggttaaggagttaacctggggcatgccagaactgggatggaatggccttgaaagattttagtgcattgcacttgacttagataggatctttactgacccttgcttacttaggagtggcagagttaattggtggttcagatattaaggggctactgtcactctgatatgtagcttttctatcatctctgtaacttagcttcaagtaactagaagagtaatctaaaaaaaataattagcctttaatcagattgcctgcagtgtttcttggtcactttaaagccgtgactttgcatgattgctaggtaagttcacttaagaaataggaaattcaaattatttatgtttcaagtatttttgaacaggtggtaaaatgaaattgatttttatcatctttgaatgaaagtaacagcagatattcaatgagtgacttattttgtggacatttttgtcctttggatatgatgtatagagtcacaatatattttcagccttttttgagaaataagtgatttagacatcttacacagttactgagcacctggtacagtgaagatctctcaagaatgatttgtgtgatgtagttcggtggatcatccagcagagggcagtagagccagagccatagtaaaagttatagtaaagttgctcttagcaacttgagtcttacttagatttaattttgcatagaaccaaaagttcagtttagtagccattttctttaaagtcaggctgtagtggttccgaaatgaaaattaggccctgattttatgtaagatgatgtccaatctttaattgacaccttaaaaatattaaaagattatgataggatcaggaaggagtttttgaaaatgcaatttgtagtttttaacaagtgatgtagaataaataaaaagaagtactttttaaaaagtaagtataaaattattttccagttaactatgggatataaatgattgctttaatacaggtcttcctaacctgtacagcatttcctaacctgctctgtgaaaaacaaagaaataaaacttagtgctctctttctctaa

SEQ ID NO: 155260 - DNA, 1785 bp, Homo sapiens
  Payload ID: 10519
  Gene Symbol: MOCS2
  Gene Name: molybdenum cofactor synthesis 2
  Uniprot ID: O96007
  ENST ID: ENST00000396954
  CDS Start-End: 679-1245
ccgtgattcggtcccgctgtcctaggcgggatggtgccgctgtgccaggtaagggtggcgggtgtgcgtgcgggcctgggtgcggagccctcctcgacgtgtctctcccgccctttccctccacatacccagccttggtcagtcggacctccccactagcccccaacctggccggcgtcttgggttcgggggcgcccccgcccccgcccccgggcccttcctgtctccgggctttactgcgactgccccagcagaagtcgggtcctctccgagaactcttgtcagctcacggcagcaaggacggactcgttctgaaggcgcctccaccttttatgaccacctctttcccagattattcgttttgatgaagctaaaattttaatctaaaaagaaatgcacctcatggagaattcttgtgaagaactgtgcttcatctgtggatttctacacccttgatcatttgcaaacctgtaattatttcgtaaagagttgtttgcacggagtgacaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaa

SEQ ID NO: 155261 - DNA, 1337 bp, Homo sapiens
  Payload ID: 10519
  Gene Symbol: MOCS2
  Gene Name: molybdenum cofactor synthesis 2
  Uniprot ID: O96033
  ENST ID: ENST00000450852
  CDS Start-End: 50-316
cgcgcctgcgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtt

SEQ ID NO: 155262 - DNA, 1251 bp, Homo sapiens
  Payload ID: 10519
  Gene Symbol: MOCS2
  Gene Name: molybdenum cofactor synthesis 2
  Uniprot ID: O96033
  ENST ID: ENST00000510818
  CDS Start-End: 14-280
tgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaa

SEQ ID NO: 155263 - DNA, 1210 bp, Homo sapiens
  Payload ID: 10519
  Gene Symbol: MOCS2
  Gene Name: molybdenum cofactor synthesis 2
  Uniprot ID: O96033
  ENST ID: ENST00000508922
  CDS Start-End: 34-300
cggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggtagaatggtctatttttaatacctgttatgattttgttttttaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaa

SEQ ID NO: 155264 - DNA, 707 bp, Homo sapiens
  Payload ID: 10519
  Gene Symbol: MOCS2
  Gene Name: molybdenum cofactor synthesis 2
  ENST ID: ENST00000527216
  CDS Start-End: 77-328
cgcaggcggcaagtgtccaggagtctggcgtctgctcgcctgcaccacgacctccctcctggggagaaggacatgcatggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctat

SEQ ID NO: 155265 - DNA, 741 bp, Homo sapiens
  Payload ID: 10519
  Gene Symbol: MOCS2
  Gene Name: molybdenum cofactor synthesis 2
  Uniprot ID: O96033
  ENST ID: ENST00000582677
  CDS Start-End: 49-315
gcgcctgcgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctagcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaa

SEQ ID NO: 155266 - DNA, 736 bp, Homo sapiens
  Payload ID: 10519
  Gene Symbol: MOCS2
  Gene Name: molybdenum cofactor synthesis 2
  Uniprot ID: O96033
  ENST ID: ENST00000584946
  CDS Start-End: 49-315
gcgcctgcgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattt

SEQ ID NO: 155267 - DNA, 5106 bp, Homo sapiens
  Payload ID: 10520
  Gene Symbol: MOCS3
  Gene Name: molybdenum cofactor synthesis 3
  Uniprot ID: O95396
  ENST ID: ENST00000244051
  CDS Start-End: 18-1400
ttccggaagaggtcgccatggcttcccgggaggaggtactcgccttacaagctgaagttgcccaacgtgaggaggaattgaattcgctgaagcagaagctggcgtcggctcttttggctgagcaggaaccgcagccagaacggctggttccggtgtcgccgctgccgccgaaggccgctctgtcccgagatgagattctgcgctatagccggcagctagtgctgcccgagctgggcgtgcacggacagctgcgcctggggaccgcgtgcgtgctaatcgtgggctgcggtgggctcggctgtccactagcgcagtacttggcagcggccggcgtgggccgccttggccttgtggactatgacgtggtagagatgagcaacctggcccgccaagtgctgcatggcgaggcactggctggccaggccaaggccttttcggccgccgcctcgctgcgccgcctcaattcggcagtggaatgcgtgccgtacactcaggcccttacgccagccactgccctagacctggtccgccgatatgatgtggtggctgactgctcggacaacgtgcccactcgctacctggttaatgacgcatgtgtgctggcgggtcggcccctcgtgtctgccagtgccttgcgcttcgagggccaaatcacagtctaccattatgacggtggcccttgctatcgctgcatattcccccaaccacccccagcggagacagtgaccaactgcgcggacggcggggtgctcggtgtcgttaccggggtcctgggctgcctgcaggccttggaagtgctgaaaatcgctgcgggtctgggcccctcttacagtggcagcttgttgctctttgatgccctgagagggcatttccgctctattcggctgcggagccgcaggctcgactgtgcagcttgcggggaacggcccactgtgactgatctgctggactatgaagccttctgtggctcctcagccactgataaatgccgctccctgcaactactgagcccagaggagcgtgtttctgtcaccgactataagcgactgctggattctggggcattccacctgttgctggacgtcaggcctcaggtggaggtggacatttgtcgtttgcctcatgccctacacatccctctgaaacatttggaacgcagggatgcggagagcctgaaactcttaaaagaagcaatctgggaagagaagcagggcacacaagaaggggctgctgtccccatttatgtgatttgcaaactgggaaatgactcacagaaagccgtgaagatcctccagtccttatcagcagctcaagagttagaccctttaacagttcgggatgttgtggggggcctcatggcctgggctgccaaaatcgatggaacatttccacagtactgaggtgactggtatagtctgatgagaaagatgtggattgccataatacctcaaagatacacttgtttgcatttttcggtaatatacataggagctggggattctacagtatctgtgaatacgtggactcctttttataaggagttttaaaaattgttatgtattggatgaatgacttattaatggattataccgtttctgagaaccatcattttttttttcagcacacggaggatgtcttggacatgtgagatgtaacgtgacaggattttgcattttaaactgcagatcatttacatgtccttattttccacctcccccagtcaaaatgctttctaaatcattttcacagattatatacttcggatctgtttactgttcagttaagaaattcttggatcttattaatatttcagatgatagaatacatcctacagaaatacatgtttaaaatgtaaattgttttaattattcagaaagagggtcattctatttggccttttgaattagtatcaaaatgagattttttttttttttttgagatggaatctctctctgttgcccaggctggagtgtagtggtgcgatctcagctcactgcaacctccgcctcccaggttcaagcgattctcctgcctcagcctcctgagtagctgggattacaggcgcacgccaccacgcctggctaatttttgtatttttagtacagagggggtttcaccatgtttgtcaggctggtctcgaactcctgacctcgtgatccgcctgcctcgacttcccagagtgctgggattacaggcgtgagccaccacaccctcccgagatctttaaagtttaccaaaataaaggaaaccacctttgtagtctgtcagtgtctcttataaattgctactgttttcttaaagttaacttcagggtccaccttatgttgcacacatatcacatcgtttaaattgcatactatggtttgacttgctttggaattttcaagtcaaagtcccaaccctttgcctctccccctttaatttgccttttctcttttgatttaatgtttttttattccagcattttatactaatgtaaaatgtttttatgtttgtttacttaacattttcataaaatagtaggtagtctcaccaacttccaatatatacaacaacattataagtaaaaatttgatttgtgagtgcctatcagtggccagatgaactaatggcttgtcagaagggggcctgtgacctcctgcttgctgcatgcaggcttataatcatcaattgctgctgttgtttttttaagaatggcagaaatcacagatacaactataaaatctttgtatttctgttaaccattttttttaaagcttaaatgtatcataagccagcaaaaaccctttgtagaccagatttacttaccagtttgcaatttgtgatatagaatcttgttttattataagagggtggtatttaacaaattcaaaattagtcatcactttttaactgtgaaacattgtaactaattctttgaacaggtatacttaaagtatggtatacccttctgttataaagatgaagcaggtctcttatgactgttcctgccaacgagttatggaggtaaatgactgtgacctggagtggagaacaaagatggctggcctgtgtttttcatctccttcttccagggacaactgattctgatacatagcaggaaacaaatagcgacacacaggaacaatttcatattctaaagactgaagtcctaaagttatagacagttgtagttcctataaacctggttgtcacaggggacaggcaagagaagctgactagctaagtgttaaaaggtttactaaagtgataggaggtgcttttgagaattttggggacagattcaaggctgtacttctaggaatgatgcccgaaatcatgcacaaaactggccttaggagaacagtgtctatgttgtgctgccctatcaagtaccggaggaaacgccactacagtctcaccagtttcacttgacgtgcccccccaactctcccagaaagcccaacacttcagccacagtccatgtgtcgagaaacagagtcactacattattcttttctgagtcaagccttatgagggtgcctggtaggcagagtctaattacatgcctacatcttagctgcaagagaggctgggaatttgtgttttgatatctacaataggaagacagaactcatgatgtgggattttcccaaatagtgaaatatttttcaaaagatgggctgttaagaatataacagatacccagtacacaacccagatctatttcagtatttgttttttgttgttgttgttttggagacagagtctcgctctatcccccaggctggatggagtgcagcggcacaatctcggctcactgcaacctccacctcccatgttcaagtgattctcatgcctcagcctcctgagtagctgggattacaggcacctgccaccacatctggctaatttttctatttttagtagcgatggggtttcgccatgttggcctggctggtcttgaactcctgacctcaggtgatctgtgcacctcagcctcccaaagtgctaggattacaggcatgagtcactgcacctggcatatattagtatttgaaatttggttttctctggggattgtagctaggtttttatggtgagataggatttgaacataatttgttttttgagacgaagtcttgcttcgtcgcccagggtggagtgtagtgttgtgatcacagctcgctgtggcctcaacctcctgggttcaagtgatcctcccacctcagcctctcaagtagcttgaattacagttgtatgccaccatgcctagccattttttaatttaaaaattttttggtagcaatggggtctgaatatgtggcctaggctgatctcaaactcctgggctcaagcatccctcctgcctcagcctcccaaagtgcttgggattacgggtatgaggcaccatgcccagcctgaacttgatttttttgttgtttccttttcataacaaacatcaaatgccttcagtgtactagttcttctaggttctggaataaaaatgagcaagaggtttcctgttgtagaggagtttatatttaaatggtgataagtaaattactgataagtgccataaaagaaatgaaactgtgacatattagggtgggggaggggatctgttttgaatagcttaattatggaaggcctcagagatgacattaaacccaaaacctgaaaggtgagaaagagccagttacagaagatctgaggaaaattctatactgggagaaaaataactgtaaagacctcaaggtaaataaacttggaatgttccgttcaagaaactgcagaggcaagttgggttgcaaacaattagggagagtgggacagggtgaggtttgagaagcagggaacatcataaactttgtagaccatagtagtttggtttttattctaaatacaataatagctaatattttgagcacttactgtgttatttgggatttgaatccagatgctctggttgaagagcccattccctaagtgtcatgctatactgactctaagcaaaactttgccattgcttcatatgtgttcatgccctgtcagggcatagaaagcaatctatgtcctgacaatcacggaagtgtattccagatacaatagaaatgtactctgaga

SEQ ID NO: 155268 - DNA, 2370 bp, Homo sapiens
  Payload ID: 10521
  Gene Symbol: MON1A
  Gene Name: MON1 secretory trafficking family member A
  ENST ID: ENST00000296473
  CDS Start-End: 260-2218
gggagaaacaatcctaacgtccctttctctcacttgaaatgaactgctagctggctcggacggagaggcccagagtccagggctgttctgtgtgggactctagactcggaggaggcgcccaggcccctagaaggcggcgccggatgaggcaatcgcggacccgggtcaggacctgcccacggctctgctgggactaggagcccagaaccagtccctcggcgccgcaggcggccaaacgctaaggactacatttcccacaatgcaccccgggggcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggtgtggcccgggacctgcaggaggagatgctgccaggaagctctgaggattggctggaacccccaggggcagttgggcgaccagccacagagccccccagggagggcacaaccgagggggatgaggaggatgccacggaggcatggcgcctgcaccagaagcatgtctttgtgctgagtgaggcagggaagcctgtgtactcccgctatgggtctgaggaggcactttccagcactatgggtgttatggtggccctggtgtccttcctggaggcagacaagaacgccatccgctccatccatgcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaagacacttgtca

SEQ ID NO: 155269 - DNA, 2527 bp, Homo sapiens
  Payload ID: 10521
  Gene Symbol: MON1A
  Gene Name: MON1 secretory trafficking family member A
  ENST ID: ENST00000417270
  CDS Start-End: 695-2386
aaacttgcactgtccttccacaatcagtgggagaaacaatcctaacgtccctttctctcacttgaaatgaactgctagctggctcggacggagaggcccagagtccagggctgttctgtgtgggactctagactcggaggaggcgcccaggcccctagaaggcggcgccggatgaggcaatcgcggacccgggtcaggacctgcccacggctctgctgggactaggagcccagaaccagtccctcggcgccgcaggcggccaaacgctaaggactacatttcccacaatgcaccccgggggcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacagggtctgctctggcacccaagctggagtgcagcagtgcgatctcagctcactgcaacctctgcctccccccgggttcaagtgattctcataccttagcctcccaagcagttgggattacaggcgcccgtcatgacacctaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggtgtggcccgggacctgcaggaggagatgctgccaggaagctctgaggattggctggaacccccaggggcagttgggcgaccagccacagagccccccagggagggcacaaccgagggggatgaggaggatgccacggaggcatggcgcctgcaccagaagcatgtctttgtgctgagtgaggcagggaagcctgtgtactcccgctatgggtctgaggaggcactttccagcactatgggtgttatggtggccctggtgtccttcctggaggcagacaagaacgccatccgctccatccatgcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaa

SEQ ID NO: 155270 - DNA, 1617 bp, Homo sapiens
  Payload ID: 10521
  Gene Symbol: MON1A
  Gene Name: MON1 secretory trafficking family member A
  Uniprot ID: Q86VX9
  ENST ID: ENST00000455683
  CDS Start-End: 4-1476
acaatgcaccccgggggcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaa

SEQ ID NO: 155271 - DNA, 6091 bp, Homo sapiens
  Payload ID: 10522
  Gene Symbol: MON1B
  Gene Name: MON1 secretory trafficking family member B
  Uniprot ID: Q7L1V2
  ENST ID: ENST00000248248
  CDS Start-End: 351-1994
ctcacgccaaccactggtaagcgaagtgggcctcgctctcccgggttagcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcgaaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggttgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctactgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcggatcacgaggttaggagttcgaggccagcctgaccaacatggtgaaacaccatctctactaaaaaactatatatacatatacatatgtgtgtatgtgtatttatatgtatgtatgtatgtgtgtgtatatatatatatatgtatatgtgtatatatatatatatgtgtatatatatatatatatacacacactaatcagccgggcgcggtggtgtgggcctgtaatcgcagctactcaggaagctgaggcaggagaatcacttgaacccgagaggcggaggttgcagtgagccgagatcatgtcactgcactccagcctgggtgacagagtgagactccgtctcaaaagaaaaaaaattctcccttggccgggcttggtggcttatgcctgtaatcccagcactttggaaggccgaggcgggtgggtcacctgaggtcaggagtttgagaccagcctggccagcatggcgaaacctcgtctctactaaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagcaaaaaaaaaaaaaaaaaaagaaaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaaggaatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgctctta

SEQ ID NO: 155272 - DNA, 1759 bp, Homo sapiens
  Payload ID: 10522
  Gene Symbol: MON1B
  Gene Name: MON1 secretory trafficking family member B
  ENST ID: ENST00000439557
  CDS Start-End: 78-1394
gtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacagaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcgaaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggttgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggc

SEQ ID NO: 155273 - DNA, 1814 bp, Homo sapiens
  Payload ID: 10522
  Gene Symbol: MON1B
  Gene Name: MON1 secretory trafficking family member B
  Uniprot ID: Q7L1V2
  ENST ID: ENST00000545553
  CDS Start-End: 23-1228
ccaccgccgctacggggaagtaatggtatccggccaattgagattcggagttaaaacagaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcgaaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggttgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaag

SEQ ID NO: 155274 - DNA, 877 bp, Homo sapiens
  Payload ID: 10522
  Gene Symbol: MON1B
  Gene Name: MON1 secretory trafficking family member B
  ENST ID: ENST00000563612
  CDS Start-End: 546-877
gaagtgggcctcgctctcccgggttagcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacaggtgtttgtatatctctatttcctgaggcccagtagagtctcctcttttcggaaagtgttggaggggggacgtatttgggcatgattttggatgtctcgtcctattgaaatccgtggggaaatgagcagtaggagtgtgtccaagggggcctgactctataaaggcttttcagaagtttctttcaccgcccgtcaccctcgattcccctcccactcagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagca

SEQ ID NO: 155275 - DNA, 948 bp, Homo sapiens
  Payload ID: 10522
  Gene Symbol: MON1B
  Gene Name: MON1 secretory trafficking family member B
  ENST ID: ENST00000564006
  CDS Start-End: 239-598
gacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggggctccctttcaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgactt

SEQ ID NO: 155276 - DNA, 611 bp, Homo sapiens
  Payload ID: 10522
  Gene Symbol: MON1B
  Gene Name: MON1 secretory trafficking family member B
  ENST ID: ENST00000569610
  CDS Start-End: 111-611
gaggcggctcatctcgattggcccagaaagaagacggtcgcgccctatgtactccgggattggctagagcgagccgcgtcccccctcacgccaaccactgggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaa

SEQ ID NO: 155277 - DNA, 576 bp, Homo sapiens
  Payload ID: 10522
  Gene Symbol: MON1B
  Gene Name: MON1 secretory trafficking family member B
  ENST ID: ENST00000563279
  CDS Start-End: 273-576
gttagcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatgggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtg

SEQ ID NO: 155278 - DNA, 1110 bp, Homo sapiens
  Payload ID: 10522
  Gene Symbol: MON1B
  Gene Name: MON1 secretory trafficking family member B
  ENST ID: ENST00000567291
  CDS Start-End: 345-1110
aaccactggtaagcgaagtgggcctcgctctcccgggttagcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacaggtggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcc

SEQ ID NO: 155279 - DNA, 5612 bp, Homo sapiens
  Payload ID: 10523
  Gene Symbol: MON2
  Gene Name: MON2 homolog, regulator of endosome-to-Golgi trafficking
  Uniprot ID: Q7Z3U7
  ENST ID: ENST00000393629
  CDS Start-End: 361-5496
agtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggc

SEQ ID NO: 155280 - DNA, 13275 bp, Homo sapiens
  Payload ID: 10523
  Gene Symbol: MON2
  Gene Name: MON2 homolog, regulator of endosome-to-Golgi trafficking
  Uniprot ID: Q7Z3U7
  ENST ID: ENST00000393630
  CDS Start-End: 392-5545
attgtgggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttgggtgtgttaaattgaggattagaaaaatccacataatcactgataaagcattgaaacagaataacccaagggtagtgtaccgattcagtaacatgttaaaaatattgctatgcatttattcaaaggaaaatggtctgttcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagttttttttttttttttcatttgagacggagtctcgctctgtcacccaggctggaatgcagtggcacgatcttggctcactgcaacctctgcttcccgggttcaagcagtttcctgcttcagacttccaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgcatagattacttcttagtttcctatgctaccaccactgccaagggagaaaaaaatacatcattttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattatttgtcctttctcagtataattttaaagagcattttgttttattgtcacaatttggtaccactagtcccaggtaaccattgggccaaaggatcagttgagaaacagttaaggatgaattagcataagttatggaacagtgttagaaaacaactcaaaagtatattctttattaatgaggtggtcattattacatttgtgtcaatgaagggcagtgtagttattttaaaatgactaatattttctccccaaatacagaataattcagatgggcaaccaagttttcaagagactgctgtaggtgaagtctgtctagccaaggcagaacacttacaggagtccctaactgtgccacccttggaatgggttagtgtacaggctcagaatattgtggattacagtttttcagagaaaactaccacagatgtagacaaaaatgatctctgaaagcattgccagcagccaggtatgttccttagatttccacttaggtttggcattttggcagataagctaatcttgtataaagcatcacattttactatgcttagtgttcctgggttgtatttatctacattattagagggaatttttattttaaaaaaattgtcattcatgagaagaatgggagttcatgccacatagtattttaccaatttatataaagtgggaaaagtctttaatacttcatgatcacttgaattaaagtttttgtatctctggaaagtagaatagtgctttcatttgaatgaaaagtgtttatagattcagaaagagagatgatatctttgtatcttgatttatatacagaccatttcagaggaagttaaatgtcttacaaatccaatactttctaatgctctaacagtgttggctatttaaaagaacatgtggcaagttctatatgaatattcttggtcatctcgactaattctgaggcaatgatggacagagatgctacttcttatttaactctaggcatgttgacttttcaaagcggtttccttatttctaaacagagatgatgatcaatgagttactaattctttagaggaaaaaatgcataatttgagtgtggagttgattttaatgacagggtaattcaagttgtttgataaatttattactatattgtaagagagatctttgaccatttttcttcctttttcttggacatcactttcttccctccccttctctcttttatgtttttatccttgttaaattttatgtttacgttaccatctttcttatactttcccctgatttttctcttttaattcctctttcattctctgcctcttctctttcagctctttctctaattgtgcctattccttgttcataagaagtggagctgttagtggtagaaccactgctcatggttctaccactacaaagtggaaagtagaaatactttgcactttggccactgttgcgtttttgccaaggtaaagttcccctgccattttgaaatagctgaacaagttaaagtaatatgttccaaaaactggaagtgccataaaaaactaaaaataaaaaaaaattgtgactataactcctactgtctttatgaatacacgggattcagcagccaagatgctcacaaaatgggattgctataaatatgatggattcagcacctaaatttggaataatcatgtcttttctgttatgtgggtagagagattatatatcttttctcaaagtaaagtatttaaaacctgtttaaatgagggttttggctggcgtggtggcccacacctgtaatcccagcactttgggaagccaaggtgggagtatcacttgaggccaggagtttgagactagcctagacaacatagcaagatcctatctctagttcaaaaaaatatttttaattagggttttggttttttatgattttggggggtgggggagatatttgtttttttgaggcagacgtttaaacttttagatttatcccatcttaatattgatttatattgacactgcctacttacaagaataatttgaggcagcatattgcccatgtatttcaactattttcatttttctgttgcaaagcagtctttgatggaagacccggaatcttatagttctcatatctgagtctttctggagtgtatttggtgtctgtgtgattggttcacccagaggtcacccagaggtcaattgaaaccttcctaattgtactatggtattgattctatcccctcaagtatgaaaaaattaaattttcagaccattttcagttgctgcgaatgtagttacactaagttttattttaaactaaaattcaataaacagtgcagccagggaagatctgctaaaccatgccgttatttggaaaatcattgcaatatattaacaactgcttccttctatgatgtttactagatggagaaaaatactccatacctatattgcaattttatttttatctagaaaaagaaaatattaggcttcagacccaactgtgcaaatttcatttgctttccatctcttactactacctctgtgtcataatttaacacgtaacatacaactcctgtctcttaaggcagctaccatatggtgtttatgtcagactggatatatttatctaattttgtgaaattattttttagttcccaacacaattcttgaaagtaataccactgttgttactctttctccttacaatttttatgttgttgagatgtatcagttatgtattataatcatgaaattgtattggcctcaaacccaaattttctttgtagtctaggatagatttttcatgaaagctatatagttataactgtgattgtacagattgtttatttgttttacagctaacattaagcatgattccaggtttttaattatgttccagcaacactagtgtttctttataacttaaaatcataaccactttgataatttacctttggatctgaccagtgattcatttttttcttgaatatactttgtgtttgctttctcatccccgttaagtctgaaacattattgacaccccacatcacttactctgtttaaagactttacgagtagtgagtcacatgtttaggatgatcactttgggaaaaaaaaaattatagagtaaaggggaaatgttcttgagagctttattaaaaccattaatatataaaatgaaaaaataataaacagaagacacgaagtgtctctcaatagtttagaaagaaagatttggaactttaagtaaaaatgctaggtcaagtaaaaatcctgatgtagattagattatcttaatcttatgagcatttttttttaatttggtgaagctgttttgaaactgcctgtccatatcaatgccagactatctctctacctctcaaagaaaataatttgcattaaaattcctttttttgttatgtaatgaaagtataaaacaagaatttgtacgttactcagtgtgtactgcagtcagatatagttaaaataatttttctgatgcgtaattttaaccaccatttctggagtacctagtatgtgcaggccaaggctttgcctatattattccctttaatcctcaaagtagccttgcaaagaagttattttcattttacagaagagtcaaggattagggggttgaagtgagctgcctagagtcacatacctaaagtccaggtggatcactatgtcttgctttttcaaaagcagttctttctactacagtacaatagtttcatgttttacagtccattaaaatccaagacttataaaataaactaaaaatactcttgaggcaattactatttctatgatgggcactgggacaaatatacttgaacataacaaagaactaaaaatactgtgaaaaaaagatttgtcttaacgatgaccttgaaagttgcattgggtttttattattggtccaggtttaaaacattttatctatttaaaacatatgttgtgtgttttaagaagttatgttataaataacagcattgtggttaagagcccagagtctggggccaggcttcttagatgcaaatcccaactctgttattttactaaatgtgtgaccttgggcaagttaattaacctgttttggtgtcctcctctgtgaaatggagttaatcgtggtatttaacagaattcaaaatgtagtgtgttctaaagcgctgtgcctggagcatcatcaccactaggtggttagggaagtaaaacacatttggcacacatcattcaagaatggccagaaaatccatgtcttcccacaatagggaccaattttttgcctttcaccagacaaccactgaatgttaagaatctactgtgtgctaataactgtgtccttgctgtatgacagaagctatttggagcgctctcaagtgcttattacagctagtcaaggaaaccgcatatataaaataatactggatacaagactatacaattaaatactggtgtatcactaacaa

SEQ ID NO: 155281 - DNA, 5708 bp, Homo sapiens
  Payload ID: 10523
  Gene Symbol: MON2
  Gene Name: MON2 homolog, regulator of endosome-to-Golgi trafficking
  ENST ID: ENST00000547095
  CDS Start-End: 361-492
agtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggtacagatgaggggtatctaactgagcctggaagttggaggaggggagtcattcctagcagaggaaatagcacacgttgctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggc

SEQ ID NO: 155282 - DNA, 3760 bp, Homo sapiens
  Payload ID: 10523
  Gene Symbol: MON2
  Gene Name: MON2 homolog, regulator of endosome-to-Golgi trafficking
  ENST ID: ENST00000552115
  CDS Start-End: 360-3578
gtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtattgtaaaatagattggactatcagcttttaatgagtcatgcttatatattaatactttttcagttaaacttatttcttttaatttttaaagaatttccatgcatttgtgtatttgacaaaacaggaaataactgtgtcatattgtaaattgtacctcataaagagcaaattaaatattaacagcctta

SEQ ID NO: 155283 - DNA, 6130 bp, Homo sapiens
  Payload ID: 10523
  Gene Symbol: MON2
  Gene Name: MON2 homolog, regulator of endosome-to-Golgi trafficking
  Uniprot ID: Q7Z3U7
  ENST ID: ENST00000546600
  CDS Start-End: 387-5414
gggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgcttgtatcagcctatttggaataccaccctacttttaaaccttgtttttaatctcttaaagttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaa

SEQ ID NO: 155284 - DNA, 5543 bp, Homo sapiens
  Payload ID: 10523
  Gene Symbol: MON2
  Gene Name: MON2 homolog, regulator of endosome-to-Golgi trafficking
  Uniprot ID: Q7Z3U7
  ENST ID: ENST00000552738
  CDS Start-End: 361-5427
agtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaagcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggc

SEQ ID NO: 155285 - DNA, 424 bp, Homo sapiens
  Payload ID: 10523
  Gene Symbol: MON2
  Gene Name: MON2 homolog, regulator of endosome-to-Golgi trafficking
  ENST ID: ENST00000549286
  CDS Start-End: 147-326
aggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcaggataaaaactgcaattatgcagtgaaactgctcagagcaaggaaacccctaggatatggggacctggtggacctttttcagcactgaaagagaacagctcaga

SEQ ID NO: 155286 - DNA, 1048 bp, Homo sapiens
  Payload ID: 10524
  Gene Symbol: MOGAT1
  Gene Name: monoacylglycerol O-acyltransferase 1
  Uniprot ID: Q96PD6
  ENST ID: ENST00000446656
  CDS Start-End: 1-1008
atgaaggtagagtttgcaccgctcaacatccagctggcgcggcggctgcagacggtggccgtgctgcagtgggtcctgaaatacctgctgctcgggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttgggctggtttcagtttccaagaaaagtgtgtcctacatggtaagcaaggagggaggtggaaacatctctgtcattgtccttgggggtgcaaaagaatcactggatgctcatcctggaaagttcactctgttcatccgccagcggaaaggatttgttaaaattgctttgacccatggcgcctctctggtcccagtggtttcttttggtgaaaatgaactgtttaaacaaactgacaaccctgaaggatcatggattagaactgttcagaataaactgcagaagatcatggggtttgctttgcccctgtttcatgccaggggagtttttcagtacaattttggcctaatgacctataggaaagccatccacactgttgttggccgcccgatccctgttcgtcagactctgaacccgacccaggagcagattgaggagttacatcagacctatatggaggaacttaggaaattgtttgaggaacacaaaggaaagtatggcattccagagcacgagactcttgttttaaaatgacttgactataaaaaaaaattaaaaaataaaaataaatgac

SEQ ID NO: 155287 - DNA, 1404 bp, Homo sapiens
  Payload ID: 10525
  Gene Symbol: MOGAT2
  Gene Name: monoacylglycerol O-acyltransferase 2
  Uniprot ID: Q3SYC2
  ENST ID: ENST00000198801
  CDS Start-End: 71-1075
aaaaacctgtgggtgcctcagaccacagcagagctcacagaacctgcgggagccaggctgacccgccagcatggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgagaagacttcctggaggtgtttgttgaacatatctgcagagccttcccagactcctgcaaatccaacccatatcaggctgtaagtcagagcaggcaatgcagaagaggagaccagaccaaggggtcagctggggctaggacagtgagggctgctagaggggctgggcctctctttgcacatggacactgggcccctctctatattgagtggtctgttaacattcattggtggctgattccaaaagatgagagccaaagctgcacggactcgagtccta

SEQ ID NO: 155288 - DNA, 3204 bp, Homo sapiens
  Payload ID: 10525
  Gene Symbol: MOGAT2
  Gene Name: monoacylglycerol O-acyltransferase 2
  Uniprot ID: Q3SYC2
  ENST ID: ENST00000526712
  CDS Start-End: 774-1532
actgtgtagttcagagtggccacagacaagaggcaggagcgggagggacagggccagctctggggctcctggaggccaggctgagctacttggactgtgcccaaagttatggggaagtcatgaagggcttgaataaggggaggcacctggctggatttatctctgggaaaatggggcagaggatgaacagaaagagagcaggaaagggtctccctttgctctgagatcccaaaagatggaaactagaacagtttatccaaccagttgtccccattgattgagcacttaatgagtacaaacaactctcctggggagaaggaggacaggcaggggatggagtgaattaggcggcctggtgcagtgggagaaagtgagctttggagttaggcctacctaggctcaacgcgtgctcccagtgacactgggctggccgtagtccctctcagggactttgtctcctctttgaatgccccggaagctgctgtcttcctcctgggcccgaggattggacaggacagtgctgctagtgccaggcctatgggcagagttcagtctgagcaatctcacctgccttcctctcagacccctgtccctgacagctccttcttccctccccagccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgagaagacttcctggaggtgtttgttgaacatatctgcagagccttcccagactcctgcaaatccaacccatatcaggctgtaagtcagagcaggcaatgcagaagaggagaccagaccaaggggtcagctggggctaggacagtgagggctgctagaggggctgggcctctctttgcacatggacactgggcccctctctatattgagtggtctgttaacattcattggtggctgattccaaaagatgagagccaaagctgcacggactcgagtcctaggctgcacacctcacaagcatctcttctactgcattctgttggtcgaagcaagtcacaacccagcagattcaaggagtaaggaataggatccccctctggatgggaggagcagcaatgtcatattacaaaagggtgtggacacatgcagggattcttactgccgtctttgcaaacaatccaccaaaacttaaaaactaaaagcctgaagcacaagcactctccaccccaggcacacacaccctggaattccctgtgtgaccatggtaccaccactgtgtgtcccgaggatcccagctcagctttgcatcgctgccctatctccctctcgctctcccctgttgatccctcatgcacagccacagcgagctgtctaaaacacaaagctgaccgcgccatttcctactcagcatccttccatgaccctccattgctcctaggatagggtttggaccagtctgaatccagaggatcaggatccagcaggaaccagaggataatttgaggagggtttaaaaaggaaccattttttgaggtgtgtgcactgtttccaccctgaggcctggaaggatgaatggaagcagcagttcctgaaccaggaagactcatgtgtgggggccattgctggtcaaggggcacgaacaggtctggtgaccctgcaagggaggagccaggagcaagcattcccacttcaccttcctccattcagtctgctgccaagttccccactgcctgagcccaactagaagctggagggaaggagggcctgtggctgcagtccaggcatgtaggcctcctgggaaagggagaatggcaaagacaggcagagtggatctggaggggtcaacggaagacggaacatgtccacttccaggcccgagcttctcagcctgccgtttgccactctccagcatctggcccagcctgtccatcctcatctctcttcctcccttactccgtgctcccatcactcggaaccatttgcatttctttgtctcagctatattgtctcacctctgagtttttgcccatgatgttggatgccatggaatgccatatcctccccattatctcccccttgtctggataattcctactcatcctacaatactgattttatctgtgcaaagaagtcttccccagtgcctctggttgacaggggtttcctctggcttctccagactttctgttcctccaccacagcccttagcaccctggggaggaggtgttgctgtccaggtaaatgctgcgccaatgcccctgcctctagtgcactccctccagcctacccacaaacaggacctgcatcctgtctcacaaataaaactgaactcttgaaatggtg

SEQ ID NO: 155289 - DNA, 1650 bp, Homo sapiens
  Payload ID: 10525
  Gene Symbol: MOGAT2
  Gene Name: monoacylglycerol O-acyltransferase 2
  Uniprot ID: Q3SYC2
  ENST ID: ENST00000525093
  CDS Start-End: 1-855
atggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacgggtatcaagcctctgggaagagcactctgggttcagttggcaattggcaaggattttattttggtgggaagatggcagagacgaatgcagattctattttggtagagattttcagtccattcacaattaagattatattttggtgtcttatgcccaaatacctagaaaagtttccacaacggagactcagtgatctaagaaactaggtggcaatgaacatattccacaaagctggcatttgatctgagatctgtggtatctagaagagtgatatttggggtacatttcagagctgttctccctccttggggtgaagcatccttgagaaacatgagccagctgaggtgggagatatttttctaggaaaaacaatgcagatttttatatctgggaggactctctgaagcattctggtctacctctcatggtgcaactgggaagttgtggccctgcaagggacctgcccaaggtcagagaatggggctgtgaaggtctgggagataacccaggcctccacctccagcccaggtggctgacctctgctccatttcttggtcactgagtccctgcaggaagctaaagggcctttcagctcgtgccttctctggggcctcccacatgccctctttcctctatttgtctccagggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctga

SEQ ID NO: 155290 - DNA, 2132 bp, Homo sapiens
  Payload ID: 10526
  Gene Symbol: MOGAT3
  Gene Name: monoacylglycerol O-acyltransferase 3
  Uniprot ID: Q86VF5
  ENST ID: ENST00000223114
  CDS Start-End: 168-1193
cactcacacacctacggacacacgctactctgggaggtgatttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacctccacccactgtggactccatgcctccaataaaaggtagttctgggcccagcgcagtgcctcatgcctgtaatcccagcactttgggaggccaaggtgggaggatcgtttgagcccaggagttgaagaccagcctgggcaacacagtgagacttcatttctacaaaaattaaaaaataatgttgttaattagccgggcatggtggcatgtgcctgtaatcccagctatttgggaggctgaggcaggagacttgcttaaacccaggaggcggaggttgcagtgagctgagatcacaccacagtactccagcctgggcaacacagcgagactcaatctcaaaaaaaaaaaaaaaaaaaaaaaaaagactgttaaagctgtagtaggctgggcgtggtggctcatgcccataatcccaacactttgggaagccgaggcaggtggatcaactgaggtcaggagttcaagaccagcctggccaaaatggcaaaaccccctctctactaaaactacaaaaattagccgggcatggtggctcatgcctataatcccagctactccggaggctgaggcaggagaatcgcttgaacccaggaggcagaggttgcagtgagccgagatcacaccactgcactccagtctgggcaacagagcgagattccatctcaaaaaaaaaaaaatgttgttaaagctataatcgttctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaa

SEQ ID NO: 155291 - DNA, 933 bp, Homo sapiens
  Payload ID: 10526
  Gene Symbol: MOGAT3
  Gene Name: monoacylglycerol O-acyltransferase 3
  Uniprot ID: Q86VF5
  ENST ID: ENST00000379423
  CDS Start-End: 62-907
caagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacc

SEQ ID NO: 155292 - DNA, 1219 bp, Homo sapiens
  Payload ID: 10526
  Gene Symbol: MOGAT3
  Gene Name: monoacylglycerol O-acyltransferase 3
  Uniprot ID: Q86VF5
  ENST ID: ENST00000440203
  CDS Start-End: 59-1093
gccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtgggtgagtgcccacctccggggggacggccaccagcagctgcgtgggcatcagggatccctcgcccacctgtctccctctccctgcagtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacc

SEQ ID NO: 155293 - DNA, 4015 bp, Homo sapiens
  Payload ID: 10527
  Gene Symbol: MAOA
  Gene Name: monoamine oxidase A
  Uniprot ID: P21397
  ENST ID: ENST00000338702
  CDS Start-End: 124-1707
cgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaatgca

SEQ ID NO: 155294 - DNA, 5438 bp, Homo sapiens
  Payload ID: 10527
  Gene Symbol: MAOA
  Gene Name: monoamine oxidase A
  Uniprot ID: P21397
  ENST ID: ENST00000542639
  CDS Start-End: 1943-3127
ggcggagccaggccggcctagagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcaccagtaccggcaccggcaccgagcgcaaggcggagggcccgcccgaagccgggggcacaactgcccaggtcccgaacccggactccagcttggacgacacctcctacagcctgtccgaatggagcgtccgttctgagtggcggtccgtctcggatccgctagccagttcccagtggagcacgtcctcaactgccgaggccgcctcctggagctccagcatacactccccaatcagcactaccggtcttagcgagagtactgactccgactccaagagtggcctccggggtttcagcgcttacaacccgagcagtcggatccccaagtctaccaccagctcgaactcctccgatggggccgtcacagcctccaatcaggacaccggcattccctgggtattagtaacaggacctaccccgcccgtaaactcccccgtagagtcattgcaagggtctgccttctcctcagggttcagcaccccacggggtttggtaaaaggaccgaccctgcccccggattccaacctgacctcagtgtccgactacacttggatatttgtacggggacctcctatacccaatgacctttcgcaagtgtcaatacaagcacctcctacacccagtaacacccccgagtgtcagtacaagggtctgccgcatcctcagtgtccagcttcccctggggtttggtaccaggaccacctctacccaataacatttccccagtgtcgccacaagcacctcctgcaccccataacatccccccagtgtcaaggcaggcgtctacccccacctcagtgcctgacactccgcggggttcaatacaagaacctcctgcacccagtaatcctttccagctgccgacacaaggacattctaaacctaataactctcgccgagtgtcagtacaagggtccgccccgctctcagtgcccagctccccccgggtatcagctgaaacatcagctccgcccctgggcgctcccggagtatcagcaaaagggttcgccccgcccacagtgcccggctccccccgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggccaagagaagagattggcatgaactgttgctttgccagttccagccagtaccagcaaaaacatacatgtatgttggagcatcagaggaaagcagctcctggtggagagactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaatgcagac

SEQ ID NO: 155295 - DNA, 2566 bp, Homo sapiens
  Payload ID: 10528
  Gene Symbol: MAOB
  Gene Name: monoamine oxidase B
  Uniprot ID: P27338
  ENST ID: ENST00000378069
  CDS Start-End: 149-1711
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccat

SEQ ID NO: 155296 - DNA, 2735 bp, Homo sapiens
  Payload ID: 10529
  Gene Symbol: MMD
  Gene Name: monocyte to macrophage differentiation-associated
  Uniprot ID: Q15546
  ENST ID: ENST00000262065
  CDS Start-End: 298-1014
agccgggctccggggcggggcgcaggagccccggggcggaggagccggggaggcgggaggcgggaggcgggaggtgttggggccgttgaagcggcctccctcccgcccccagccgcccggtctggccccagccctgtcccgacccccggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgtttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgttcca

SEQ ID NO: 155297 - DNA, 670 bp, Homo sapiens
  Payload ID: 10529
  Gene Symbol: MMD
  Gene Name: monocyte to macrophage differentiation-associated
  ENST ID: ENST00000571578
  CDS Start-End: 230-670
gggaggtgttggggccgttgaagcggcctccctcccgcccccagccgcccggtctggccccagccctgtcccgacccccggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatg

SEQ ID NO: 155298 - DNA, 2335 bp, Homo sapiens
  Payload ID: 10530
  Gene Symbol: MMD2
  Gene Name: monocyte to macrophage differentiation-associated 2
  Uniprot ID: Q8IY49
  ENST ID: ENST00000401401
  CDS Start-End: 197-937
gctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatgcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacaca

SEQ ID NO: 155299 - DNA, 2415 bp, Homo sapiens
  Payload ID: 10530
  Gene Symbol: MMD2
  Gene Name: monocyte to macrophage differentiation-associated 2
  Uniprot ID: Q8IY49
  ENST ID: ENST00000404774
  CDS Start-End: 196-1008
ctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcgaacagggagctgtgtgcagtttcttcgtggggaggcatgtcctaaggccggcacggcttgtcttcctgccaggtacaagcttgtggagcttctctgctacgtcgtaatgggcttcttccccgccctggtcatcctctccatgcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacacattccacaga

SEQ ID NO: 155300 - DNA, 2372 bp, Homo sapiens
  Payload ID: 10530
  Gene Symbol: MMD2
  Gene Name: monocyte to macrophage differentiation-associated 2
  Uniprot ID: Q8IY49
  ENST ID: ENST00000406755
  CDS Start-End: 175-756
ctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatggcggggaaactgaggcctggcatgacttgtctaaagaggcagtaggccagcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacacattccacaga

SEQ ID NO: 155301 - DNA, 778 bp, Homo sapiens
  Payload ID: 10530
  Gene Symbol: MMD2
  Gene Name: monocyte to macrophage differentiation-associated 2
  Uniprot ID: Q8IY49
  ENST ID: ENST00000612910
  CDS Start-End: 197-778
gctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatggcggggaaactgaggcctggcatgacttgtctaaagaggcagtag

SEQ ID NO: 155302 - DNA, 4642 bp, Homo sapiens
  Payload ID: 10531
  Gene Symbol: MGLL
  Gene Name: monoglyceride lipase
  ENST ID: ENST00000265052
  CDS Start-End: 565-1506
cccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaatggc

SEQ ID NO: 155303 - DNA, 1414 bp, Homo sapiens
  Payload ID: 10531
  Gene Symbol: MGLL
  Gene Name: monoglyceride lipase
  ENST ID: ENST00000398101
  CDS Start-End: 500-1333
ggatcctgacttcagctgtttttagttgcttatcacccaggctttctaaaagtttcacttcttgttaaaaaatatagtatctcacatcctagagtaatgaacgtccatttttttaaagcaatttgcttttcctcatgcaatcttctttgttttttaaagtgatacttaacaataatttcagcagaagtgaaacttgggttgccaggtgtctgtacttttattaggtttgactgaccctgagctccaaacaatggaactagcactgtttgggaacttctgtaatctcacagaggacaacagatctaactgaatgttttcaagggaaaataaaaaggtctgttccatgttaaacctgggagcttttagcgtgaaggaactgagccgaaagatggtttaacgcttgcactctaagagagccaggattctaactgaaggtgcagaccagctgccccatctctttgcagagctgaacaggagaaaatccttgtaagtgggagagatgcagactagattcagaaggatcttcccctggaaggatgcgagcaccaagagaatgccagaatttatacatttttctcctctgaaaccatacaaagggagggaatgggagaaggcggggagcgagcacgtgctggaaacccaccttttgccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgc

SEQ ID NO: 155304 - DNA, 4235 bp, Homo sapiens
  Payload ID: 10531
  Gene Symbol: MGLL
  Gene Name: monoglyceride lipase
  Uniprot ID: Q99685
  ENST ID: ENST00000398104
  CDS Start-End: 188-1099
acctcgggccgcccccgccgccgagccggcccagggataaagtggcggcgcagacgccgcaccctgtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaatggc

SEQ ID NO: 155305 - DNA, 4941 bp, Homo sapiens
  Payload ID: 10531
  Gene Symbol: MGLL
  Gene Name: monoglyceride lipase
  Uniprot ID: Q99685
  ENST ID: ENST00000434178
  CDS Start-End: 898-1809
gtcgccgcgaagccggtcgcgcgcagctcgtcccggccctggcccgccgcaaacgaggatccgctgcgctcggggaacgcgacagcggcgctcgtggccccggtaactgcctcccggcccctgccccagcccgccagtgccgccgtcaggggtggggagcagcactggggtcccggacacgcccggcgtgggctcccgctacccatgtgtgcgtgtgtgtgtgtgcacggtgtgtgtgcgcgcgtgtccgagtgtgcgcgcgtgtgcgcgcgcgcgcgccctccctgctccttcgcaccagcccccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 155306 - DNA, 4552 bp, Homo sapiens
  Payload ID: 10531
  Gene Symbol: MGLL
  Gene Name: monoglyceride lipase
  Uniprot ID: Q99685
  ENST ID: ENST00000453507
  CDS Start-End: 565-1416
cccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaatggc

SEQ ID NO: 155307 - DNA, 716 bp, Homo sapiens
  Payload ID: 10531
  Gene Symbol: MGLL
  Gene Name: monoglyceride lipase
  ENST ID: ENST00000496306
  CDS Start-End: 1-629
cattacagggaggcgccatcgccatcctcacggccgcagagaggccgggccacttcgccggcatggtactcatttcgcctctggttcttgccaatcctgaatctgcaacaactttcaaggactattcgaggattttgaaacacttgatggaaaaggcatcaagaatgttaaagttttggattccacgtcctttttgggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaa

SEQ ID NO: 155308 - DNA, 410 bp, Homo sapiens
  Payload ID: 10531
  Gene Symbol: MGLL
  Gene Name: monoglyceride lipase
  ENST ID: ENST00000494830
  CDS Start-End: 179-410
acagctaaaatagtctttaagatgaagtttcctgaaatgatttaaaataaacacagatgggaagggggaaaaactgtaatgaggcacttaaaaaataaagtgagcattttcttaagaacaaatgggatttttcagtcttggagaggtttgcaagaaatgacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatg

SEQ ID NO: 155309 - DNA, 556 bp, Homo sapiens
  Payload ID: 10531
  Gene Symbol: MGLL
  Gene Name: monoglyceride lipase
  ENST ID: ENST00000493611
  CDS Start-End: 289-556
tgatccagctcaacgacctgtctgtctgcattaacagtagcctgaattatgacagtagtggctgtgctcccaaagggggttaaagtacttgagctatcccttctggaagcacagccccttttgaagacagaagatgctgactaattagcagttccagccgtgctcctcagtagccaagggaaatgcaggaaagaaatcccatcagccaatcccagaaatatcagggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatc

SEQ ID NO: 155310 - DNA, 653 bp, Homo sapiens
  Payload ID: 10531
  Gene Symbol: MGLL
  Gene Name: monoglyceride lipase
  ENST ID: ENST00000484451
  CDS Start-End: 1-594
ccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagaga

SEQ ID NO: 155311 - DNA, 549 bp, Homo sapiens
  Payload ID: 10531
  Gene Symbol: MGLL
  Gene Name: monoglyceride lipase
  ENST ID: ENST00000487473
  CDS Start-End: 1-468
ccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgc

SEQ ID NO: 155312 - DNA, 2950 bp, Homo sapiens
  Payload ID: 10532
  Gene Symbol: MOXD1
  Gene Name: monooxygenase, DBH-like 1
  Uniprot ID: Q6UVY6
  ENST ID: ENST00000336749
  CDS Start-End: 229-1866
tttccaaggaaggaaaggcacacaatggtatcaaatgttcattcattccatctcttgatgctctacgatattatcagtctacactatgctttcctgaaaggccagaagttcaaagatggactagtttcccagggacctgattccccagttggaatactccagccccttggaaattcccgggatttataaaataactctagacaacaagactttgtctttaaaggtcctatgaattcttttctctctgtatttaggtatcctgatttttcttttccatattttccacaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaac

SEQ ID NO: 155313 - DNA, 3059 bp, Homo sapiens
  Payload ID: 10532
  Gene Symbol: MOXD1
  Gene Name: monooxygenase, DBH-like 1
  Uniprot ID: Q6UVY6
  ENST ID: ENST00000367963
  CDS Start-End: 120-1961
gcgcggccggcccgaggggcggtccctgggctcccgctcgccgccgctgccgctcctcgttctgctcctcactccccagcggctggaggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaactaaatgaaattaca

SEQ ID NO: 155314 - DNA, 2191 bp, Homo sapiens
  Payload ID: 10532
  Gene Symbol: MOXD1
  Gene Name: monooxygenase, DBH-like 1
  ENST ID: ENST00000392401
  CDS Start-End: 50-397
actccccagcggctggaggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccagccttgcttgcttgtctcaaaaactgaggcctgtgatgcgaagtgtcttcagcagcagggtaattgctgccgggccacttgctgaggaagtgcttggaactgatttgaaatcacagaaaacagtgagcattctttgtggttaacgatgtgcttcttttaagcacaccccagccaacggcgacaaagaaatgtttggaaagcaaattgaaaggctgtaagggagagatgaagagagtgtgcaaccctgacacagctcagctggtgctttgttaagagatatttataagtcttcagattatgccccccaatttccaggcaacgaagagacttctccaagtgtcgtgctttgtgcattagtaataaggacacatgctccacagtaatgctggaacacaggatgatgctcttcagctgtgtgcttcttcctggcggagcagatgatttcataattagcctgaggaaacaggcagacctaacagccaaggaaacaatgcacctgaattgacaaacgaagttcaaggctttaggcaaccaatggcatatttctagagtgttggaaggagaggcaagagtctacttcaaagaaactgaatggtggtttattgatttttcatttgtaatagagccatattaaaataaagttactggtgaaggggatgaattcattacacattgtcatgtttctggaagtatttgatccatacgtaatacaaaaaaactgcgtatggatgactcacaatgctttttattgtaacttaaaaaaaactggtaaagaacttttaaacaggaaaaacatttctccaggaagcttcttctaaatctatttctttttaacttgttaaatttcagtagaaaaaaaaagctgttcataaggacaccatatagcatatacgcaaaaatgtctgcaaaaataatttcaaatggataatttttattaactgtaagctagggattgtatatctgagtatcatacaaataatgtatagatcagatttaatttattatgaaggtctatcttattcatctaatttagccaaacattgtgagaaaatcttgacgccattctttcttttatgagctaaatattgatttttgcatatttactcgctgcctcttaagagctcatatttcggttgattcccctcaaacctcctactcttccttgcctctcccctcaatgtttcaggtgagaaaactaaaccttaggtaactattaaatggcgtattgggccatacagatcagcagcctggatttattcctctgagtcccagtttggtactcttcttctcctgaaagcaaactgtagcttacataaaaacatatgttaattttcctcctaaatagtgaaagaacatgtataatcagatacattttaaacaaattgataaaatgaaatcatggcatttctcttactgcttttattccactataaatggcacactgacacatttccataatatgatttttatgatttttcattcatcatatgccataccttgtgataagtccttacagtgtgttctcatgcaattctcgtgatagtcctgtgaggtcaatatcttattactctcattttgtaggtgtataaatgtgggccttcatgtcacaaagcatggaaattgtctgtggctgtcatatgactgtttcaggaaagtactcagaatgttggaatgttcatttactgaatattcactgaatgtttattgaacacttcgagatgctggggacacaacattgaatgagataaaaccattggtatcacggagcccgtattgtggtggtgggggtagcattaaacaaataaataagcaagagaaacatcagaaagtactaagtgctaagtgctgtgcagataattaaaacggagtgatgtgataa

SEQ ID NO: 155315 - DNA, 3764 bp, Homo sapiens
  Payload ID: 10533
  Gene Symbol: MORC1
  Gene Name: MORC family CW-type zinc finger 1
  Uniprot ID: Q86VD1
  ENST ID: ENST00000232603
  CDS Start-End: 84-3038
gtgggagtgggcgcgggcgcaggcgaacggctgccggtcaggtgtccttgtccccttgagttgcgcgggtcgtgttcgagggcatggacgacaggtaccctgcgcttcagcgggcccagctgcgtctggatttcatccacgccaactccaccactcacagtttcctttttggagcactggctgaattgctggacaatgcaagagatgcaggggctgaaagacttgatgtcttttcagtggataatgaaaaactgcaggggggattcatgttgtgtttcctggatgatggatgtggcatgagccctgaggaagcttcagacatcatttactttggacgatccaaaaaacggctgtcaaccttgaagttcatagggcaatacggcaatggtcttaaaagtgggtccatgagaattggaaaagactttattctttttacgaagaaggaagaaacgatgacctgtgtgtttttttctcagacattctgtgaagaagaaagtcttagtgaggttgtagttccaatgccctcatggttaataagaaccagagaatctgtcacagatgatccccagaaatttgcaatggaattatctataatttataaatactccccatttaaaactgaagcagaattgatgcagcagtttgatgtgatctatggaaaatgtggtactttgctggttatttataacttgaagcttctgcttaatggagaaccagagttggatgttaaaactgacaaagaagatatactgatggctggagctctggaggatttcccagcgaggtggtcattcagagcctacacatctgttctgtattttaacccatggatgagaatattcattcaagccaagagagttaaaactaaacatctttgctattgcctctacagacccagaaagtatctttatgtcacatcttcttttaaaggagcatttaaagatgaagttaaaaaggcagaagaagcagtaaagattgctgaatccatattgaaagaagcacaaatcaaagtaaaccagtgtgacagaacctctttatcttctgccaaggatgtattacagagagctttggaagatgtagaagcaaagcaaaagaatcttaaagagaaacaaagagaattaaaaacagcaagaacgctctccctgttctatggagtgaacgtagaaaaccgaagccaagctggaatgttcatttacagtaataaccgtttgatcaaaatgcatgaaaaagtgggctcacagttgaaactgaagtccttacttggcgcaggcgtggttggaattgttaatatacccttggaggtcatggaaccatcccataataaacaggaatttctcaatgtccaagagtataatcatctactaaaagtcatgggacagtacttggtccagtactgtaaggacaccggcatcaataatagaaatttaacattgttttgcaatgaatttggataccagaatgacatcgatgtggagaaacctttaaattcttttcaatatcaaagaagacaagccatgggtatcccattcatcatacaatgtgatctttgtcttaaatggagagtcttgccttcctctactaattatcaggaaaaagaattttttgacatttggatttgtgctaataatcccaaccgcttggaaaacagttgtcatcaggtagaatgtctaccttccatcccactgggcaccatgagcacaatatcaccatcaaaaaatgagaaagagaagcaacttagagagtcggtcataaagtatcaaaatagactggcagaacagcagccacagcctcaatttataccagtggacgaaatcactgtcacttccacctgcctaacttcagcacataaggaaaataccaaaacccagaaaatcaggcttttgggcgatgacttgaagcatgaatctctttcatcctttgagctttcagcgagccgtagaggacagaaaagaaacatagaagagacagactctgatgtagagtatatttcagaaacaaaaattatgaaaaagtctatggaggagaaaatgaactctcaacagcagagaattccagtagctctgccagaaaatgtcaaactagctgagagatcccagagaagtcagattgctaatattaccactgtctggagagctcaaccaactgaagggtgcctgaagaatgcccaggccgcttcttgggaaatgaaaaggaagcagagtctgaactttgtagaggaatgtaaggtattgactgaagatgagaacacgagtgattcagatataatcctggtttcagataaaagcaacactgatgtttcattgaaacaagaaaaaaaggaaattcctcttttaaaccaagaaaaacaggagctgtgcaatgatgttctagcaatgaaaagaagctcttcattacctagctggaaaagcttgctcaatgtgccgatggaagatgtgaatctaagttctggacacatagccagagtttctgtgagtggcagttgtaaagttgcttcttcgccagcgtcttctcaaagcacacctgtcaaggaaacagtgagaaaactgaagtctaagttaagggagattcttctgtatttttttcctgagcatcagctaccatcagaattggaagaacctgcattaagttgtgagctggagcagtgcccagagcagatgaacaaaaagctgaaaatgtgtttcaaccagatacagaatacttacatggtccaatatgaaaaaaaaataaagaggaaattgcagtccattatctatgattcaaatacaagaggaatacataatgaaatctctctggggcaatgtgaaaataaaagaaaaatctctgaggataagctgaagaatcttcgtataaaactggcactattgttgcagaaactccaactgggtggtccagaaggtgacctggagcagactgacacttatttagaagctttgcttaaagaagataatcttctcttccagaacaatttaaataaagtaactatagatgcaagacatagactccctttagaaaaaaatgaaaagacttcggaaaattaagtcagagatggtattaccttttaaaaaatgctaataagaaaattggaagattcttttaaaaatttttcttttttgttgttgttactgtaaagtctattctgtttaacaataagaaataagaaataatttttttcaaataagaaaattgtgtactctagaaatggagaccgatttacaatttatgtattccctaatccaattatctaaatcttccttttctttcagaaatattaataatatctagagttctctaattttcatgtgagctactgaaaaaaatgaaaatgtcactcaagcttaacttttgttattccttaaaagattgttattgtaattttgttattccttaaaaacatttaaaagcagattttttcaaaatcgatatgtgaaggactacagaatcacctcctcttgaagatattgaaaaagaaagacattatgccctttctccactatagccaacactcagtcaagcagaaaatacaaatccccccaaaactttgagacatagcttatataattttattatttagtcatagtaaaagaataaatctcctaagcataatatgtatacatattacacatatgtaaaaattgttgttttacatttacatatacgtaaagaagtatgtttttacacttttcttgataagtgttttttttttgtttagaaatgtctgaaactttagacaaaaacagtaaaacatttaatattcatttgtgaaa

SEQ ID NO: 155316 - DNA, 3056 bp, Homo sapiens
  Payload ID: 10533
  Gene Symbol: MORC1
  Gene Name: MORC family CW-type zinc finger 1
  Uniprot ID: Q86VD1
  ENST ID: ENST00000483760
  CDS Start-End: 45-2936
aggtgtccttgtccccttgagttgcgcgggtcgtgttcgagggcatggacgacaggtaccctgcgcttcagcgggcccagctgcgtctggatttcatccacgccaactccaccactcacagtttcctttttggagcactggctgaattgctggacaatgcaagagatgcaggggctgaaagacttgatgtcttttcagtggataatgaaaaactgcaggggggattcatgttgtgtttcctggatgatggatgtggcatgagccctgaggaagcttcagacatcatttactttggacgatccaaaaaacggctgtcaaccttgaagttcatagggcaatacggcaatggtcttaaaagtgggtccatgagaattggaaaagactttattctttttacgaagaaggaagaaacgatgacctgtgtgtttttttctcagacattctgtgaagaagaaagtcttagtgaggttgtagttccaatgccctcatggttaataagaaccagagaatctgtcacagatgatccccagaaatttgcaatggaattatctataatttataaatactccccatttaaaactgaagcagaattgatgcagcagtttgatgtgatctatggaaaatgtggtactttgctggttatttataacttgaagcttctgcttaatggagaaccagagttggatgttaaaactgacaaagaagatatactgatggctggagctctggaggatttcccagcgaggtggtcattcagagcctacacatctgttctgtattttaacccatggatgagaatattcattcaagccaagagagttaaaactaaacatctttgctattgcctctacagacccagaaagtatctttatgtcacatcttcttttaaaggagcatttaaagatgaagttaaaaaggcagaagaagcagtaaagattgctgaatccatattgaaagaagcacaaatcaaagtaaaccagtgtgacagaacctctttatcttctgccaaggatgtattacagagagctttggaagatgtagaagcaaagcaaaagaatcttaaagagaaacaaagagaattaaaaacagcaagaacgctctccctgttctatggagtgaacgtagaaaaccgaagccaagctggaatgttcatttacagtaataaccgtttgatcaaaatgcatgaaaaagtgggctcacagttgaaactgaagtccttacttggcgcaggcgtggttggaattgttaatatacccttggaggtcatggaaccatcccataataaacaggaatttctcaatgtccaagagtataatcatctactaaaagtcatgggacagtacttggtccagtactgtaaggacaccggcatcaataatagaaatttaacattgttttgcaatgaatttggataccagaatgacatcgatgtggagaaacctttaaattcttttcaatatcaaagaagacaagccatgggtatcccattcatcatacaatgtgatctttgtcttaaatggagagtcttgccttcctctactaattatcaggaaaaagaattttttgacatttggatttgtgctaataatcccaaccgcttggaaaacagttgtcatcaggtagaatgtctaccttccatcccactgggcaccatgagcacaatatcaccatcaaaaaatgagaaagagaagcaacttagagagtcggtcataaagtatcaaaatagactggcagaacagcagccacaggaaaataccaaaacccagaaaatcaggcttttgggcgatgacttgaagcatgaatctctttcatcctttgagctttcagcgagccgtagaggacagaaaagaaacatagaagagacagactctgatgtagagtatatttcagaaacaaaaattatgaaaaagtctatggaggagaaaatgaactctcaacagcagagaattccagtagctctgccagaaaatgtcaaactagctgagagatcccagagaagtcagattgctaatattaccactgtctggagagctcaaccaactgaagggtgcctgaagaatgcccaggccgcttcttgggaaatgaaaaggaagcagagtctgaactttgtagaggaatgtaaggtattgactgaagatgagaacacgagtgattcagatataatcctggtttcagataaaagcaacactgatgtttcattgaaacaagaaaaaaaggaaattcctcttttaaaccaagaaaaacaggagctgtgcaatgatgttctagcaatgaaaagaagctcttcattacctagctggaaaagcttgctcaatgtgccgatggaagatgtgaatctaagttctggacacatagccagagtttctgtgagtggcagttgtaaagttgcttcttcgccagcgtcttctcaaagcacacctgtcaaggaaacagtgagaaaactgaagtctaagttaagggagattcttctgtatttttttcctgagcatcagctaccatcagaattggaagaacctgcattaagttgtgagctggagcagtgcccagagcagatgaacaaaaagctgaaaatgtgtttcaaccagatacagaatacttacatggtccaatatgaaaaaaaaataaagaggaaattgcagtccattatctatgattcaaatacaagaggaatacataatgaaatctctctggggcaatgtgaaaataaaagaaaaatctctgaggataagctgaagaatcttcgtataaaactggcactattgttgcagaaactccaactgggtggtccagaaggtgacctggagcagactgacacttatttagaagctttgcttaaagaagataatcttctcttccagaacaatttaaataaagtaactatagatgcaagacatagactccctttagaaaaaaatgaaaagacttcggaaaattaagtcagagatggtattaccttttaaaaaatgctaataagaaaattggaagattcttttaaaaatttttcttttttgttgttgttactgtaaagtctattctgtttaacaataagaaataag

SEQ ID NO: 155317 - DNA, 4469 bp, Homo sapiens
  Payload ID: 10534
  Gene Symbol: MORC2
  Gene Name: MORC family CW-type zinc finger 2
  Uniprot ID: Q9Y6X9
  ENST ID: ENST00000215862
  CDS Start-End: 1365-4277
cgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcgtaagtatcctctaggtgccactgaggtaaccagtaactcgttccttgatattatatggaaatcgtttccccagaaaattttgctttttcactttttgagatgtatcccactggagtgaaatgtgtcactggatatcttgagctctgtattgaagaactgagatcagtgaaatacttgttgctaatccagaagaatctgatttttgtttattggatcaaaattttctaaatgcaaactttagttatttgaagtcaatatgttgagttgtttcattcaagtgtttataggaatccaacaaatactgctctattggatcgccaaatgttggactattttagtatcaaccgtttcccctctgtagtgacaacgtcctaaacagttaggtttataacaagtgtttactttctaacaagaaaacagaagacatttaaatgacaactttcaagaagaaaatttttattttttcagaagttggcattatcttcctggcagattgctcacatccaatattatttgtatatgctaaacaggaaacggcaacttgtttatatctctatttagatagtctttccccaaaatttccacagaaacatacagtgttcatggttcttgagttcatgaaggagtaatctaatcactccaacatggtctggaatgtttcaggtttaatccatatgcccactctcttggaggctgtccagtagcgtcaaaactttagtgttttaatacattcacctgttacttttgagatgaagttcacctttcttggatcacatgcaaaggatgtttaggtctgtgaagaaaagaatttctaggccgggtgctgtggctcacgcctgtaatcccagcactttgggaggccgagaaccactcacgaattcttgtttggtgcccttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccatccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 155318 - DNA, 5181 bp, Homo sapiens
  Payload ID: 10534
  Gene Symbol: MORC2
  Gene Name: MORC family CW-type zinc finger 2
  Uniprot ID: Q9Y6X9
  ENST ID: ENST00000397641
  CDS Start-End: 410-3508
aggaaatttcggggaaccaaaaaaggctggaagaacatgaagatggagcagtcataaaccacccactcaaggaccatctccttcaggaccatccacacgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcaaccactcacgaattcttgtttggtgcccttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccatccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaagatgctgtgcctgtgagaccatacttttttttttttttttttttttttttttttttttttggtgactgcaaaggacagagaacctttccactttggccatactgggttgctaagccggagccatttcagctcctggctcctcaagataacggcgagtccagtgccatcttggagaagctccaggggcagggctgacttttctcctacaggaggaacaatgtggggatctgagggatgggagggagacttccccctagagtggtggtcctgctgggggctcatatccagggacccaaaaggggggctgtgtaggaggttccacattggaggggctctctctctcgcagctgtcagagttggtcctggctgtggcgtccaaacagcttgagggaaaaagatcctgtctaaccacctcatctactactcaagttctttctgaaggagggatttcttcagttaaccatggacagtgaggtttctcaccacagtaacttgagtccaggttgagggggagacagatctgtggtaaatctctgacttgggcagcacactgagtgtggaaccccacaggactccttagggaaggagcttgtgtgtgaaagaacccctggggctgagctggtgacctccatgtgtgggtgcagcagggccttggatggtgccaattgatctggacagcctgttgatgcttttctacttccacccttcggcctggccccactgagccccatcaaggtgcctgaagagggggccagtgagatcccgtggccacagggactccagaggcatctctgcaggaagcacaccatgccttccctccatgttccatcacggcgccacaatctgtgtcccttaacttctcagggtcaaagacaaaggcaagcgttgctgaattttctctttaatggccattggaagagtctggttcagtttttcccaactctcttcccactcgtatttggggcctctgggttttctgaaggcacaaggactgtgactttgtaccactaacctgtggttcaaacctgggtgtgtttctggcatctccctaacccagatcagcaatggccaccctgctcctctgaggtcagcagaagactgggaagcagaggtgagggatgcaggccacactggaatgggaagtcttttccccactggatgtgcctgtctggtgggttttggaccttcccagactacatctctaggagaggcctgtttggagtagtacactgagagaccctggcctcttctgctggaagactgtccaagtcttggggtttcttgagctggtgattcctctgccatcctgctctctctcttcatctcaggcagcatggggtccacttttgtccccaaacctaatgttttaatccaaatgcaaattggttccacatttttactggagggtaatcagtttttaaaattcacacacatgtaatcgaaacgcaatactataaagttctactggtgagactcctgaa

SEQ ID NO: 155319 - DNA, 766 bp, Homo sapiens
  Payload ID: 10534
  Gene Symbol: MORC2
  Gene Name: MORC family CW-type zinc finger 2
  ENST ID: ENST00000445980
  CDS Start-End: 1-574
ccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 155320 - DNA, 462 bp, Homo sapiens
  Payload ID: 10534
  Gene Symbol: MORC2
  Gene Name: MORC family CW-type zinc finger 2
  ENST ID: ENST00000429468
  CDS Start-End: 1-270
ctcttgctctgctcccaacagaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 155321 - DNA, 4246 bp, Homo sapiens
  Payload ID: 10535
  Gene Symbol: MORC3
  Gene Name: MORC family CW-type zinc finger 3
  Uniprot ID: Q14149
  ENST ID: ENST00000400485
  CDS Start-End: 77-2896
agggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggcttattgcagtatattatatctaaagccaagaatgcagatcatcctacgtggacagaaagtgaagacacagctggtttcgaagagtcttgcctacatcgaacgtgatgtttatcgaccaaaatttttatctaaaacagtgagaattacctttggattcaactgcagaaataaagatcattatgggataatgatgtatcacagaaatagactcatcaaagcttatgaaaaagttggatgtcagttaagggcaaacaacatgggtgttggagtggttggaattatagagtgtaatttccttaagccaactcataataaacaagatttcgactatactaatgagtacagacttacaataacagcactaggagaaaagctgaatgattactggaatgaaatgaaagtgaagaaaaatacagaatatcctctaaatttgccagttgaagatatacagaagcgtcctgatcagacatgggttcagtgtgatgcctgtctaaagtggcggaaattacctgatgggatggatcaacttcctgaaaaatggtattgctccaataaccctgacccacagttcagaaattgtgaggttccagaagaacctgaagatgaggatttggtacatcccacttatgaaaaaacctacaaaaagaccaacaaggaaaaattcaggatcagacaaccggaaatgatccctcggattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctggaaagagcaaataaatgaagattgtttttatttgcctgataaagtaattgaaagtgtatttttggtatgaagctggttttctgtcacaattgtaatttcccaaattttaaaatatcttataataaaataaaaatatatgatggctaactgttcaaatgcta

SEQ ID NO: 155322 - DNA, 934 bp, Homo sapiens
  Payload ID: 10535
  Gene Symbol: MORC3
  Gene Name: MORC family CW-type zinc finger 3
  ENST ID: ENST00000549948
  CDS Start-End: 3-578
ctgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatatattgaagtattgccaagatatgagacttcgaaaatgtggctcacagttgcagacagaacaactgttgtttaacagaacaacgtgggctttcatgatgctcgagtagcagtggcgcgatcacagctcactacagccgcaatctcccgggctcagtaaaagcagcgcatccagaggtacttgtttcctggccttctgcgaagcccacagataaattaggtctcatttggaaacgtcccatttcgaaaagcctgagcattttgcagctttctcctgtcttgaagaagtagaacggtgcccgagaaacgtttttccccttcgagactcaggaggatgaaagtcatc

SEQ ID NO: 155323 - DNA, 867 bp, Homo sapiens
  Payload ID: 10535
  Gene Symbol: MORC3
  Gene Name: MORC family CW-type zinc finger 3
  ENST ID: ENST00000551788
  CDS Start-End: 3-578
ctgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgagtcaagtcttcctaatctcccatggggttcctgttggaagtgaggctcttggtttgtactgtgatctgaaccatgactgaattaagtaaaagcagcgcatccagaggtacttgtttcctggccttctgcgaagcccacagataaattaggtctcatttggaaacgtcccatttcgaaaagcctgagcattttgcagctttctcctgtcttgaagaagtagaacggtgcccgagaaacgtttttccccttcgagactcaggaggatgaaagtcatc

SEQ ID NO: 155324 - DNA, 1028 bp, Homo sapiens
  Payload ID: 10535
  Gene Symbol: MORC3
  Gene Name: MORC family CW-type zinc finger 3
  ENST ID: ENST00000546482
  CDS Start-End: 3-578
ctgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgagtcaagtcttcctaatctcccatggggttcctgttggaagtgaggctcttggtttgtactgtgatctgaaccatgactgaattaagactcaacaggttggatgatgccccagatactgcccaggttggtgagggcggatcttctgtactcagtctactgattcaaatgctaaagtcttccagaaacaccctcatagtcagaagtaatgttgaccacctatcggttcagagtcgtgacacttcaagagtaaaagcagcgcatccagaggtacttgtttcctggccttctgcgaagcccacagataaattaggtctcatttggaaacgtcccatttcgaaaagcctgagcattttgcagctttctcctgtcttgaagaagtagaacggtgcccgagaaacgtttttccccttcgagactcaggaggatgaaagtcatc

SEQ ID NO: 155325 - DNA, 875 bp, Homo sapiens
  Payload ID: 10535
  Gene Symbol: MORC3
  Gene Name: MORC family CW-type zinc finger 3
  ENST ID: ENST00000552581
  CDS Start-End: 1-680
ctgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaaatattgaagtattgccaagatatgagacttcgaaaatgtggctcacagttgcagacagaacaactgttgtttaacagaacaacgtgggctttcatgatgagtcaagtcttcctaatctcccatggggttcctgttggaagtgaggctcttggtttgtactgtgatctgaaccatgactgaattaagtaaaagcagcgcatccagaggtacttgtttcctggccttctgcgaagcccacagataaattaggtctcatttggaaacgtcccatttcgaaaagcctgagcattttgcagctttctcctgtcttgaagaagtagaacggtgcccgagaaacgtttttccccttcgagactcaggaggatgaaagtcatc

SEQ ID NO: 155326 - DNA, 2940 bp, Homo sapiens
  Payload ID: 10536
  Gene Symbol: MORC4
  Gene Name: MORC family CW-type zinc finger 4
  Uniprot ID: Q8TE76
  ENST ID: ENST00000255495
  CDS Start-End: 110-2812
ggtcccggacggtcgccgccagctgcgagtggaagtgagcgagggctagtcccggaccgccgggccaggggtccggcggcagcagacgggtaccgtggcggccaaaaaaatgctcctgtaccgaggggcccccgccggccctggcgcgccgggctgcgggctggcccggcccggcggcggcccgcaggccttcgggatccgcctgagcacgatgagcccccgctacctccagagcaactccagcagccacacgcgacccttcagtgccatcgcggagctgctagataatgctgtagatccagatgtatctgccaggacggtctttatagatgttgaggaggtcaagaataaatcttgtttgacctttaccgatgatggatgtgggatgacacctcataaactacaccgaatgctcagctttggctttacagataaagtaataaagaagagccagtgtcccattggggtctttggtaatggtttcaagtcaggctccatgcggctaggaaaggacgcccttgtcttcaccaagaatgggggtactctcactgttggacttctatcacagacctatctggaatgtgtccaggcccaggcagttattgtaccaattgttccattcaaccagcaaaacaaaaaaatgattattaccgaggattcattgcccagcctagaagccatcttgaactattccattttcaaccgtgaaaatgacctgctggcccagtttgatgccatcccaggcaaaaaaggcactcgtgttctcatttggaacatccgcagaaataaaaatggaaaatctgagttggactttgatacagatcaatatgacatcctggtatcagactttgacacagaagaaaaaatgactggcggtgttacctctgagctaccagaaacagaatattctttaagggcattttgtggtattctatacatgaagccacgcatgaaaatttttctgcgtcaaaagaaggtgactacccagatgattgccaagagcctggccaatgtagaatatgatacatataaacctaccttcacaaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctct

SEQ ID NO: 155327 - DNA, 3834 bp, Homo sapiens
  Payload ID: 10536
  Gene Symbol: MORC4
  Gene Name: MORC family CW-type zinc finger 4
  Uniprot ID: Q8TE76
  ENST ID: ENST00000355610
  CDS Start-End: 276-3089
atatttctgtacggcccagaggcagcccgggcagtcgccgggtcggtagaggtgctgacagggcggagccgccgcttgcctcagccggcctcacccctcccgcccgggacaggtggctggagcgcgctccgcctccgccagctgcgagtgggagcgagggagggccggtcccggacggtcgccgccagctgcgagtggaagtgagcgagggctagtcccggaccgccgggccaggggtccggcggcagcagacgggtaccgtggcggccaaaaaaatgctcctgtaccgaggggcccccgccggccctggcgcgccgggctgcgggctggcccggcccggcggcggcccgcaggccttcgggatccgcctgagcacgatgagcccccgctacctccagagcaactccagcagccacacgcgacccttcagtgccatcgcggagctgctagataatgctgtagatccagatgtatctgccaggacggtctttatagatgttgaggaggtcaagaataaatcttgtttgacctttaccgatgatggatgtgggatgacacctcataaactacaccgaatgctcagctttggctttacagataaagtaataaagaagagccagtgtcccattggggtctttggtaatggtttcaagtcaggctccatgcggctaggaaaggacgcccttgtcttcaccaagaatgggggtactctcactgttggacttctatcacagacctatctggaatgtgtccaggcccaggcagttattgtaccaattgttccattcaaccagcaaaacaaaaaaatgattattaccgaggattcattgcccagcctagaagccatcttgaactattccattttcaaccgtgaaaatgacctgctggcccagtttgatgccatcccaggcaaaaaaggcactcgtgttctcatttggaacatccgcagaaataaaaatggaaaatctgagttggactttgatacagatcaatatgacatcctggtatcagactttgacacagaagaaaaaatgactggcggtgttacctctgagctaccagaaacagaatattctttaagggcattttgtggtattctatacatgaagccacgcatgaaaatttttctgcgtcaaaagaaggtgactacccagatgattgccaagagcctggccaatgtagaatatgatacatataaacctaccttcacaaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaagatcaa

SEQ ID NO: 155328 - DNA, 2027 bp, Homo sapiens
  Payload ID: 10536
  Gene Symbol: MORC4
  Gene Name: MORC family CW-type zinc finger 4
  ENST ID: ENST00000604604
  CDS Start-End: 1-115
atctgccaggacggtctttatagatgttgaggaggtcaagaataaatcttgtttgacctttaccgatgatggatgtgggatgacacctcataaactacaccgaatgctcagttaggaatccaacttacaggggatgtgaaggacctcttcaaggagaactacaaaccactgctcaatgaaataaaagaggatacaaacaaatggaagatcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaaggcaaaagaaaaaagctggaggcatcacactacctgacttcaaactatactacacggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatctaataaatggtgctgggaaaactggctagccatatgtaaaaagctgaaactggatcccttccttacaccttatacaaaaattaattcaaggtggattaaagacttaaacattagacctaaaaccataaaaaccctagaagaaaaccttggcattaccattcaggacataggaatgggcaagcacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcacaacctactcatctgacaaagggctaatatccagaatttacaatgaactcaaacaaatttagaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccactatgagatgccatctcacaccagttagaatggcgatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggactataaatcatgctgctataaagacacatgcacacgtatgtttattgcggcactattcacaatagcaaagacttggaaccaagccaaatgtccatcaatgatagactggattaagaaaatgtggcacatatacaccatggaatactatacagccataaaaaatgatgagttcatgtcctttgtagggacatggataaaattggaaatcatcattctcagtaaactattgcaaggacaaaaaaccaaacaccgcatgttcagactcatagatgggaattgaacaatgagaacacatgaacatacgaaggggaacatcacactctggggcctgttgtggggtggcgggaggggggagggatagcattaagagatatacctaatgctaaatgacgcgttaatgggtgcagcagaccagcatggcacatgtatacatatgtaactaacctgcacattgtgcacatgtaccctaaaacttaaagtgtaa

SEQ ID NO: 155329 - DNA, 2049 bp, Homo sapiens
  Payload ID: 10537
  Gene Symbol: MRFAP1
  Gene Name: Morf4 family associated protein 1
  Uniprot ID: Q9Y605
  ENST ID: ENST00000320912
  CDS Start-End: 654-1037
gtctcactctgatgcacaggctggagagcagtggcgcgatatgggctcactgcaacctccgcctcccgttttcaaacgattgtctcagcctcccaagcagctggggttacacgcgtgcaacacgacgcccggctaatttttgtatttttggtagagacggggtctcgccatgtcggccaggctggtctcgaattcctgacctcaagccatccacccacctcgcctcccaacgtgctgagattacaggcgtgagccaccgcgcctgggaagtgcgggaggcctttttaaaaaatgtaaactcgcgtgctcaagaagccctatcggagggaaacacccagaagaggccaccctccaaacacagggtaaaacaggggtgacgcacagaggtaacgggaaagcaggaacgagcgagagcgtgcggtcccgtacctgcgcgtgcctgcgtgcgcgtccgtgcggccgcgacgccgccgccggtgcctctctttctagacgtgcgcgcgcccgcagctcgcccccctgaccgtaaagaggcccggctgtgtcgtgaaaggggccgcaacgcgcagagcgctggttgacggccgggactccattttgttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaa

SEQ ID NO: 155330 - DNA, 1584 bp, Homo sapiens
  Payload ID: 10537
  Gene Symbol: MRFAP1
  Gene Name: Morf4 family associated protein 1
  Uniprot ID: Q9Y605
  ENST ID: ENST00000382581
  CDS Start-End: 173-556
ttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaagacgaaagacctaaaa

SEQ ID NO: 155331 - DNA, 563 bp, Homo sapiens
  Payload ID: 10537
  Gene Symbol: MRFAP1
  Gene Name: Morf4 family associated protein 1
  Uniprot ID: Q9Y605
  ENST ID: ENST00000507420
  CDS Start-End: 106-489
ttttgttcgccgttactctgcgcgtaagtcgcttgtccgtggcttctctgagaagaaaagttgaaaaaggacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaa

SEQ ID NO: 155332 - DNA, 2112 bp, Homo sapiens
  Payload ID: 10537
  Gene Symbol: MRFAP1
  Gene Name: Morf4 family associated protein 1
  ENST ID: ENST00000617365
  CDS Start-End: 773-1084
gtctcactctgatgcacaggctggagagcagtggcgcgatatgggctcactgcaacctccgcctcccgttttcaaacgattgtctcagcctcccaagcagctggggttacacgcgtgcaacacgacgcccggctaatttttgtatttttggtagagacggggtctcgccatgtcggccaggctggtctcgaattcctgacctcaagccatccacccacctcgcctcccaacgtgctgagattacaggcgtgagccaccgcgcctgggaagtgcgggaggcctttttaaaaaatgtaaactcgcgtgctcaagaagccctatcggagggaaacacccagaagaggccaccctccaaacacagggtaaaacaggggtgacgcacagaggtaacgggaaagcaggaacgagcgagagcgtgcggtcccgtacctgcgcgtgcctgcgtgcgcgtccgtgcggccgcgacgccgccgccggtgcctctctttctagacgtgcgcgcgcccgcagctcgcccccctgaccgtaaagaggcccggctgtgtcgtgaaaggggccgcaacgcgcagagcgctggttgacggccgggactccattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaagacgaaagacctaaaa

SEQ ID NO: 155333 - DNA, 1593 bp, Homo sapiens
  Payload ID: 10538
  Gene Symbol: MRFAP1L1
  Gene Name: Morf4 family associated protein 1-like 1
  Uniprot ID: Q96HT8
  ENST ID: ENST00000320848
  CDS Start-End: 252-635
cgagttgacggctgcgactccattttgtaggccgcttatttgtgtgcatccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcacgggcgggcgtacctgcggaccaggagcaagctgtgggagatggacaatatgcttatccagatcaaaacgcaggtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatcggtggttcacagctgaggactgtagtcaactggtaaggatgaactgacaccttgaggaaactgaaacagcttgtcattttctctgttttgtttttgtatgttttttaccccgatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtggcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaa

SEQ ID NO: 155334 - DNA, 1648 bp, Homo sapiens
  Payload ID: 10539
  Gene Symbol: MORN1
  Gene Name: MORN repeat containing 1
  ENST ID: ENST00000378525
  CDS Start-End: 139-609
ctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagctctgatccacccatctatagtaggagaaactcaaggagacatcggctgctacccaggcaccatgagctcagggttggtgaggcccctccgggagacctgttctccctctcgacagcagcttcttctgacggaaaataagaacagcggatcccaaagcagagaaggctcctcttccacagggacaggagccacgcggctcaggccggtcccggaagccacagaggtcctgggccacgagcacccccaccagcctgtgacgcctcagccatctccgtcccccacactcctagtttacagcttactgctcgacctcccaggacccgagggcttgggcaggccccacacgtcctccagaacatcctcggtgggagacggagcagacagagtagaggccacacgtgtgtgtgcacatcagagtgtctcctacccatgttggcagcagcgcggccctccgggcatccctggctgtatcagctgcgccgtgagtgttggctgtctcacacgccagctttcccggagttgccgctgggtgccgagcacctgctcactgcacggagcaggtggctccttctgggcggctttgcctgccgcagtccccgagcctcctctcctcagctgggcgtgtgtgggaatgcccaaccgggggcctccacggggcctatagcctccacgtttgggcctactgcccttggacccaggggtcacagtccaggaagcctgggccagtgggggactcctggggtgcatgtaacactgagaatcatgtagataatttggggtgtttgagcacgcatggcctgtggggagtctggccggcttgcctcatgtggaccccccaccaccctggggcagaggagggggccggctgttggggccgtcatggaagcactagggttacactagggcaggccccatgtcccctctggaactcctcacagttcacaccttgaagcccaggcacttgcgatgggaccagcgaggtcaaatgcaggacccctggtcctcactgttaccatgaagtgatgcaaatggccggtcttcaga

SEQ ID NO: 155335 - DNA, 1500 bp, Homo sapiens
  Payload ID: 10539
  Gene Symbol: MORN1
  Gene Name: MORN repeat containing 1
  Uniprot ID: Q5T089
  ENST ID: ENST00000378529
  CDS Start-End: 175-1227
gacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgggagctcactcttctaggatcagacgagtctccttccagacaacagctgtgagaggaccagcaagcgcaggcgtcattcatcatataaaagagcatgcaggcatcccaggtggggcagcagggcccggcgccactccacgggaggccaaggcggccaagcctcaggccaacaggcccacggggggcccggcccgcgcccccttgtctgccttcacctcagttgatagaagcagttccacaccgcataggtggaatagctctcatatttctgcataaaaatacttactggg

SEQ ID NO: 155336 - DNA, 1798 bp, Homo sapiens
  Payload ID: 10539
  Gene Symbol: MORN1
  Gene Name: MORN repeat containing 1
  Uniprot ID: Q5T089
  ENST ID: ENST00000378531
  CDS Start-End: 175-1668
gacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgccaggggacatgcgccccattgtcccggggcctgtcagcgagtggagcagggctgtgccgagttcacagatgtcctcctggggccgcccccgcctgggtaccaccccttcctgttcctggacagcctccacaagaaggcaggcggcagatccagaggcggcctgcaccccagggggacaccacccacggcacaggagcctcctggaggcagcaggcctgaggggagagccacggaggagcaggctgcggcagcacacctaggggagtacgtgctcatgatccgcgacgtgaccaccccgccgttcctggggcgcaggctgcccccggccttcaaacacctgcgggtcgtagcgaagagggctggccagccaccccatgtcctggaagaaggccctgaagcctcaagcagctggcaggccgcccacagctgcaccccagagccgccagcgcctcggtgaggccccgtgtccacaggaggccacctcggtgtgaatggaaggaaacgctgcctctgcttgcgtgactctgctccccgattctccagagccccgtggttgctggcttgaataaaatgctcagtggcggcta

SEQ ID NO: 155337 - DNA, 4764 bp, Homo sapiens
  Payload ID: 10539
  Gene Symbol: MORN1
  Gene Name: MORN repeat containing 1
  ENST ID: ENST00000449373
  CDS Start-End: 1-558
gtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagctctgatccacccatctatagtaggagaaactcaaggagacatcggctgctacccaggcaccatgagctcagggttggtgaggcccctccgggagacctgttctccctctcgacagcaggtgtgttttctgcaaaccgtgtctcctgccttgcagccagtattccttaatgcaaagctctatgaagaacctttttttaaaaatgcattctagaaaaaaatgcattcctgaaaataaacgtgttacagcttcttctgacggaaaataagaacagcggatcccaaagcagagaaggctcctcttccacagggacaggagccacgcggctcaggccggtcccggaagccacagaggtcctgggccacgagcacccccaccagcctgtgacgcctcagccatctccgtcccccacactcctagtttacagcttactgctcgacctcccaggacccgagggcttgggcaggccccacacgtcctccagaacatcctcggtgggagacggagcagacagagtagaggccacacgtgtgtgtgcacatcagagtgtctcctacccatgttggcagcagcgcggccctccgggcatccctggctgtatcagctgcgccgtgagtgttggctgtctcacacgccagctttcccggagttgccgctgggtgccgagcacctgctcactgcacggagcaggtggctccttctgggcggctttgcctgccgcagtccccgagcctcctctcctcagctgggcgtgtgtgggaatgcccaaccgggggcctccacggggcctatagcctccacgtttgggcctactgcccttggacccaggggtcacagtccaggaagcctgggccagtgggggactcctggggtgcatgtaacactgagaatcatgtagataatttggggtgtttgagcacgcatggcctgtggggagtctggccggcttgcctcatgtggaccccccaccaccctggggcagaggagggggccggctgttggggccgtcatggaagcactagggttacactagggcaggccccatgtcccctctggaactcctcacagttcacaccttgaagcccaggcacttgcgatgggaccagcgaggtcaaatgcaggacccctggtcctcactgttaccatgaagtgatgcaaatggccggtcttcagaaaccagagctagccccacccgtgccaccaaggcacaccagcccctgagcagtcgcagggcccaggcagaagggtccggcaggctcctcactcatgacgtggcctgagggggctgggcagctggtcctcggagcccccacctggtgcaccaggccgtgaacctcagcaaaggccccgtctcttgatgcccaaggtttggcaatggttgggggttactttctccagaccacagcaccctcgaggccaacactggggaaagctggagcccctgctcttcacccccacctcccagggctgttgaaccccaaggagcaccagacccaggacccccccaggagggccagaggcaggaagtgcctgatggtgccaggggagggtggatgcctgactagggcctgaaaacagagggcatagcttccaataaagcatggaaagaaaacagcatgaatggaccagaagtgcttcccattgggagaaagaagagcactcacaacctcttctgccccaggctgcttggagtgggccagcgccagagcagtccctgcaccagccgagccgtccgagcttgtcgactatcagggaaggtgtgagccttcggctgagtggtgctgggagctggggagagccgagcactgcccggggcctcctgagtgctctgccacccggctgggcagggaagggagggcccctcacagaggacacccttgtggtcctggggtcgcctttgtgaccgagggggacgtatgtgtgtcaccatcatcctgcacgactgcttcctgactttggaaccgctgtttgcctctgtgttttgggtgtggacctggaccccagtggcccttccccaaaggtcgtgtgaccaccaccaccttcccgtgtcccgtaccgcacacctgtgctcacctgggtgccaggcagtggcccagcagggaggaggagggtgagcaggtggcaaaatgcccattcctcggtcccagcctgtgtgtggctgaggccccgcacgtaactctccacgctgggcatcggcctggactgtgcctgggtgctccctgaggcccgggtgggaggcagctgctccaggactctcagtgtcccagtctgtgccgtcagcaggaggatcaggagcctcccctgcaccctatttaataagctcttgctcgttcctgcttggggtacatgaaacagaaacagccgaattgtcaaaggtgtgattgataacgtgaattagacaagaccgggctattggatcagttgaattgatcactcaaatgtgcttggactgaccaagtgctgcatgaaagcttgcctggctcagccctcccacccggacaccagcggtgggtaccgaggatgccaagccctgacctgattgctgcgcacccagggagggggatgccaggcaggctcgtgccacatacgtgagccgcagccccagaccaaccatgggaggagccactcaccccaaaggcgggctctgcacctctgcatttctcatgactcgagtgtgtctggcttcccctgcccagccacagcctcactgggtactcaccctggacgccatattgcagctggtgtcagccctgccccgcagctccacctccctcctcctgaaagcccggggcaccttccagaggccgagcaggtggaagggggcagagaccagacatcgccattctcatcactgacggtgacgggggccccggacgccctgaagagccctcagctgtgcgctgactcgcgcctctccccgtccagcgtgaatgagatgagagacagtgaggacaatggtcccaggaagggaccctcaagagatgccaatcaaatgcgttggactctcacccagtttggtgggaacgtctggagtcataggacagagagctgagggggcaaggctgaggggaggtgctctgtggatgcaagggtgcccacggcctccaacagggcatggcatggcctccaggcatgccgtgcagcagcagtcagggcagcccatggactctgcgccagtccttggtagctgaagcccagaaccactctcacctgaccccacatgtggtcagctctggggcccccatccactgtagttgccagtgtggatggtgcttgcccagagcccagggtggcacggtgaaccggactctgatcttcagggcaactgtctaggccgatggggtgacgtcagtggtgcgctcagcttggaacactgcaggaatgcagccgggtgggtgctggctgggatcttggggtctgggagctggaggaacaagagcctcaggagcaagggccctgtccagacagcagccgggcctctgcccacctggcaccccgagctggctgcccagcctctcctgaagctgagagctgcctttttgctgcctccgggcacccacgcgggctgccagttgtctcggatcggagccccctgcctggaggcgtgagccgtgctcccagccagcagctgtgagttgcccccaccctgccccagcccttcatgtactgtggctctccctggcctttggggcaatccagtcgccttcaggactgtctgcagaggccctgtctccctgcagccagagagagctccagcgccatccacttgtccctgatctgccacactcctcagccctggccctcggccctcgctgtctcttcccacacatcccagggcccaggatccgtggagaagccccagaaggcacacgctgcgccctgcagacctgccaccgctgcctcggggttcccctgggaaaggcacccagggagggccgggcagggaagcaggagcccacttggctcctgccagagagtgaacagaagcaaaacgtgcctttggttaatttttcttctaatagaagtaattcagagtcaaatgaaataccatttaaattttccatgaaaataatcaccctgctatttcacatgattttcccaggctttgttgtatgacttggaaaccaggcttgttatgaaggaggcagagttggggtgtacagcgaacaggcatttctcccaagctcacgggcacattttttcaaactgtgttttttaattggcctcttcatgtataaatgaacagtgtaacggacaagcagggcaccttaatcccaacgccacagtcggccagtttgcgggttcaggcctcctttatgatacatgccacaaacacaatatctttgtattaaaaggattttttttttttgctgaaa

SEQ ID NO: 155338 - DNA, 406 bp, Homo sapiens
  Payload ID: 10539
  Gene Symbol: MORN1
  Gene Name: MORN repeat containing 1
  ENST ID: ENST00000494279
  CDS Start-End: 1-182
gttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggtgagctctagctgggatggcacattcactcctttctcataacccatcgggctcagttggtccgccgagtctagatgcagaaggcgtgacgtgtagacgggaagctttgtgccgtgagaggcctggcctaccgagaagccctggggacctgactgaggctctgtggtcaccgctgagagcaactcaggcttccggagacacttttctagaataaagatttatctgtcccaagtta

SEQ ID NO: 155339 - DNA, 741 bp, Homo sapiens
  Payload ID: 10540
  Gene Symbol: MORN2
  Gene Name: MORN repeat containing 2
  Uniprot ID: Q502X0
  ENST ID: ENST00000340556
  CDS Start-End: 308-547
attcgcttccgggtgagaggtgcccggtcgccccagcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgcttacacctttttgaactttatattcattgtcttacaattagtttaaaataaatgacatgattcaa

SEQ ID NO: 155340 - DNA, 750 bp, Homo sapiens
  Payload ID: 10540
  Gene Symbol: MORN2
  Gene Name: MORN repeat containing 2
  Uniprot ID: Q502X0
  ENST ID: ENST00000410014
  CDS Start-End: 380-619
gccccagcaaccaagtcgcacctggagctgtcctagcgcctagttctctcccggccgcagagctggccgcccagggggagtcgcagagtttggaagatctctctaacacctctcggccaagtgagtgtccctcctcctaacgacccgggcagagaagagctcctttaagtcgaactagcgtggagtcagaacctgcttggctcccggtaactcctgtggggcttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgctt

SEQ ID NO: 155341 - DNA, 648 bp, Homo sapiens
  Payload ID: 10540
  Gene Symbol: MORN2
  Gene Name: MORN repeat containing 2
  Uniprot ID: Q502X0
  ENST ID: ENST00000409665
  CDS Start-End: 277-516
cctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgtttttctcctctgtttagatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgctta

SEQ ID NO: 155342 - DNA, 465 bp, Homo sapiens
  Payload ID: 10540
  Gene Symbol: MORN2
  Gene Name: MORN repeat containing 2
  ENST ID: ENST00000409077
  CDS Start-End: 143-283
ctcccggccgcagagctggccgcccagggggagtcgcagagtttggaagatctctctaacacctctcggccaaatggtgactgtacaagaacatcttctggaatctacgagagaaatggaataggtattcataccactcctaatgggattgtctacacaggaagctggaaagatgacaagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgcttacacctttttgaactttatattcattgtcttacaattagtttaaaataaat

SEQ ID NO: 155343 - DNA, 544 bp, Homo sapiens
  Payload ID: 10540
  Gene Symbol: MORN2
  Gene Name: MORN repeat containing 2
  ENST ID: ENST00000409131
  CDS Start-End: 234-407
gagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgcttacacct

SEQ ID NO: 155344 - DNA, 919 bp, Homo sapiens
  Payload ID: 10540
  Gene Symbol: MORN2
  Gene Name: MORN repeat containing 2
  ENST ID: ENST00000441049
  CDS Start-End: 279-485
gccccagcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaataggggaagtcaagcctctctactgcttctttttataacctttaagttaattcagaacccagataagccttgatctgaggatgatataaccaccgcaggcaacatgggaacttctagagaaaacaagaagaagacttcaaaaaacatgctgtgatgtctcccagtggagacagggcacgaggtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaagg

SEQ ID NO: 155345 - DNA, 3803 bp, Homo sapiens
  Payload ID: 10541
  Gene Symbol: MORN3
  Gene Name: MORN repeat containing 3
  Uniprot ID: Q6PF18
  ENST ID: ENST00000355329
  CDS Start-End: 172-894
agtccagcactaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgaagaacgggaaccgctacgagggctgctgggagagaggcatgaagaacggggcggggcgtttcttccatctggaccacggccagctgtttgaaggcttctgggtggacaatatggccaaatgcgggacgatgatcgactttggccgtgacgaggcccctgagcccactcagttccccattcctgaggtcaaaatcctagaccctgatggtgtgctggcggaggccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggtataagcctgggcctatgggataaggatggggcactcgagggggctcagcagggctttcaggtttagaagagggaagacctgccttggctgggctgcctgggtttagcttgggggagtaagggcaggtcttaggccgggtgcagtggctcattcctgtaatcccagaacttgggaggccaaggtaagaggactgcctgaggccaggagttcgagaccagcttaggcaacatagcaagaccctgactctacaaaaaaaaattttaaaatataaaagaaaggaaaagaaaaagagaaagaaatggcaggtcccctgtgagataacccagatgacccagagagaaggcctgtatcctgccacactggctgccaagattggagatcataaaatttcctgaccacttctcagcctaacacagggctctcaaccttgaaatcccatggaaactttgcaaagctgtggaagcccaggtcccatgcccagagattcacaggttcacatctaattcatctggggtgaggcctgagctttcagaaaattccccaggtgattttttttttttaagacgtagtctccctctattgcccaggctggaatgcagtggcgcgatctcagctcactgcaacctctgcctcccatgttcaagcgattctcctacctcagcctcctgagtagctgggattacaggcgcatgccactgagcccagctaatttttgtatttttagtagagatggggtatcaccatgttggtcaggctggtcttgaactcctgacctcgtgatctgccccgctcagtctcctaaagtgctgggattacaggtgtgagccatcgagcctggccttttttttttttttttttttttttttgagacagagtcttgctctgtcacccaggctggagtgcagtggcacaatctcggctcactgcaacctcgcctccctggttcaagcgattatcctgcctcagcctcccaagtagctgggattacaggcacctgccaccaaggctaattttttgtatttttagtagagacagggtttcaccatgttggccaggacggtctcgatctcctgacctcgtgatctgcccgccttggactcccaaagtgctgggattacaggtgtgagccactgctcccagccaagatcagatgttcttgcataatgggcaggtgagctctggagtcacagtgcctgggcgtgaatctcggagctgtgtgttctcaggaatgtcacccaaactctgttctgttggtctcctcacttgcaatatggggcattaacagtacttaccacctggggttactgtggttagttactgtgaggatgagataaggcggtggttttaaactgtgggtaggattttgtcctccctcagccccactctttcttggggacatttggcaatgtatgacatttttgatgtcacaacaggcaggaagaaggctactggcattgagtgagtagagaccagggatgcggttaagcatagtgcaatatcaccatgctacaaaaaaaaaaaaaaaaaagaattcagcacctgtaatcccaactacttgggaggctgaggcaggagaattgcttgaacctgggtggcagaggttgcagtgagccgagattgcgccattgcactccagcctgggcgacagagcgagacaccatctccaaaaaaaaaaaaaaaaaaaatgttgagaaaccctgaaataccacgattctagctaagacctcagcaagaggcacatagcacatagtaaagcctcaataaacaccactgaccttactgaggttctctctgccccctaagtcataagtagggtggcctcaccaagggtgtggttctcagtctgtacctctggcactgggaagccccgcctggccaccctaggatgcagaattaatcataacttccagatatggagcactcactctattccaggccgtgtgctgacagcttcgcagcaagcattctctcctggcactccccgacaacagtgaggtgtcttgctattactgccattttagaggaggaaacaggttcagggaggatcacaagtcatcaagctagtactgtgcttaaacttaggtctagctgttcttaatgtgcagaagagtgtaaagggttaccatttttaaagaaaaagtgggggcagggcatggtggctcatgcctgtaatcctagcactttgagaggccgaggcaggcggatcaagaggtcaggagttcgagaccagcctgaccaacatggtgaaaccctgtctctactaaaaatacaaaaattagctgggtgtggtggagtgcatctataatcccagctactcaggaggctgaggcaggagaatcacttgaacccaggaggcggaggtagtggtgagccaagatcacgccgagccgagatcgtgccgctgctctccagcctgggcaacagagcgagactccatctcaaaaaaaaaaaaaatgttggaagagggtgtgcttgtttatgtacaaaatgtcgctagatttaaacacaataaactggcaaagatggttgtctctggggagaattggggacttgggaacaggagctgaagaacaacttttcagtgttgtgtttggaaccatgtgaatgtattatgtattcaaaatgtaaataaaaatgaagttaaagaga

SEQ ID NO: 155346 - DNA, 964 bp, Homo sapiens
  Payload ID: 10541
  Gene Symbol: MORN3
  Gene Name: MORN repeat containing 3
  Uniprot ID: Q6PF18
  ENST ID: ENST00000392462
  CDS Start-End: 168-650
cagcactaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgagtcaaaatcctagaccctgatggtgtgctggcggaggccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtgg

SEQ ID NO: 155347 - DNA, 879 bp, Homo sapiens
  Payload ID: 10541
  Gene Symbol: MORN3
  Gene Name: MORN repeat containing 3
  Uniprot ID: Q6PF18
  ENST ID: ENST00000542364
  CDS Start-End: 83-565
cccgcggcgcgcgcagctgacggacattgaggctggatgctgcgatcccgcagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgagtcaaaatcctagaccctgatggtgtgctggcggaggccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtgg

SEQ ID NO: 155348 - DNA, 2315 bp, Homo sapiens
  Payload ID: 10542
  Gene Symbol: MORN4
  Gene Name: MORN repeat containing 4
  Uniprot ID: Q8NDC4
  ENST ID: ENST00000307450
  CDS Start-End: 165-605
cggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgccta

SEQ ID NO: 155349 - DNA, 419 bp, Homo sapiens
  Payload ID: 10542
  Gene Symbol: MORN4
  Gene Name: MORN repeat containing 4
  ENST ID: ENST00000370635
  CDS Start-End: 176-316
gcccaggatggcggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccagtttcatccttttatcctgtaatctgtcaccatgaccctgacaaaaggttccttcacctactccagtggggaggaatatcgtggcgagtggaaggagggtgagaaggacccctggggagtatccatgatgaacacttcatttgctggaggacaaatacatcaggatatatagccaactttatggatcttcattttcaactccaggatttaattccatatagtgcctgccattcctttattccattttaggattaaataaaggaatttgaaaatgc

SEQ ID NO: 155350 - DNA, 2225 bp, Homo sapiens
  Payload ID: 10542
  Gene Symbol: MORN4
  Gene Name: MORN repeat containing 4
  ENST ID: ENST00000478953
  CDS Start-End: 185-385
agtgcggtcgcccaggatggcggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgccta

SEQ ID NO: 155351 - DNA, 705 bp, Homo sapiens
  Payload ID: 10543
  Gene Symbol: MORN5
  Gene Name: MORN repeat containing 5
  Uniprot ID: Q5VZ52
  ENST ID: ENST00000373764
  CDS Start-End: 63-548
atagtgatgccgtatccactgagactccggatcctaacagctggaagctaaaaacaggcgccatggagtacacagggagcaaatatatcggggaatatgtagatgggaggatggagggcaaagccaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcagatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtcagtggc

SEQ ID NO: 155352 - DNA, 366 bp, Homo sapiens
  Payload ID: 10543
  Gene Symbol: MORN5
  Gene Name: MORN repeat containing 5
  ENST ID: ENST00000418632
  CDS Start-End: 35-366
gtgagaggtctgaacagtgatgtccagttcaaggatggagggcaaagccaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggctt

SEQ ID NO: 155353 - DNA, 596 bp, Homo sapiens
  Payload ID: 10543
  Gene Symbol: MORN5
  Gene Name: MORN repeat containing 5
  ENST ID: ENST00000536616
  CDS Start-End: 66-356
gtcatagtgatgccgtatccactgagactccggatcctaacagctggaagctaaaaacaggcgccatggagtacacagggagcaaatatatcggggaatatgtagatgggaggatggagggcaaagccaagtacatcctccctaccgaaacaatatatgttggggaaatgaaggatggcatgtttcacggcgagggaaccctgtacttccccagcggaagccaatacgacgccatttgggaaaacggattggccataaaggtatggctcaactcaccaatatggacccacctagaaaaatccccaagggctattacgattgtggagacggcttctataacccagtcacgagggtagtcaaggactataggaaccgctttctaagaaacgcagatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtcagtggc

SEQ ID NO: 155354 - DNA, 2359 bp, Homo sapiens
  Payload ID: 10544
  Gene Symbol: MORF4L1
  Gene Name: mortality factor 4 like 1
  Uniprot ID: Q9UBU8
  ENST ID: ENST00000331268
  CDS Start-End: 205-1293
gcgtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaaaagtgctgtgaggcccaggcgctctgaaaaatctttgaagacacatgaggatattgtagccctttttcctgttcctgaaggagctccctcagtacaccaccccctcctgacctctagttgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaagaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaa

SEQ ID NO: 155355 - DNA, 2274 bp, Homo sapiens
  Payload ID: 10544
  Gene Symbol: MORF4L1
  Gene Name: mortality factor 4 like 1
  ENST ID: ENST00000379535
  CDS Start-End: 565-1611
aacccatggccgggaaaagaagctcctgctccccgctccactcccggcgtcttcacacttggggaagggagaggcaggaagtgcaaggaccgcgcaagacccggccccccgagccgccaggggccgcgccagcagcccagatgcggtgggcgggagctgggggggcggcggggtcccgcgaagacctgcgacctggcgccctcgccggctgtgtcccggccagcccgctttccaggcgagcctcgctaaggagtgtgagaaaccaaatcctcagtgggtaaaccgcgctccgtccagcccactcggacgagagctctcccgggagccaggcgcgttgctgcacccgaggtggggaaaccggagcccgaagagcggaaggggcttattccaggcgacaggcagtgtcagtaactgaatcaggggccgaggaagtttccccagaagcgcggcttcgctcccggcccggcccgaccccgactactgtcccctaatacccagggagcggaagacgcgaccaactccaggcacagcggagccggcgcggggtccacaaagcaaaaaagaatgatccccttcccccatcctcaagtgactgatgctcttggaagatactccaactatatcctgagtagcactgtggagagccccagtctgagaagcatgaactttgagaagcaaggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttc

SEQ ID NO: 155356 - DNA, 1880 bp, Homo sapiens
  Payload ID: 10544
  Gene Symbol: MORF4L1
  Gene Name: mortality factor 4 like 1
  Uniprot ID: Q9UBU8
  ENST ID: ENST00000426013
  CDS Start-End: 243-1214
agtcccggcgtgccctggggcggcgcgggcgcaggggcgcgtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaa

SEQ ID NO: 155357 - DNA, 1468 bp, Homo sapiens
  Payload ID: 10544
  Gene Symbol: MORF4L1
  Gene Name: mortality factor 4 like 1
  Uniprot ID: Q9UBU8
  ENST ID: ENST00000559345
  CDS Start-End: 439-1146
gaatcacttataaatggcgccgaagcaggacccgaagcctaaattccaggagggtgagtgtgcgcctttgggaaaaaggcacctaacggcgcaggagatagaggcgggctcgaggtgattgaggcttgagggccgggggcggcgcgggctgcgccctgagaaggcggcggtcagtgctttgtgcggggaaagcgcattgcggatggcaattccggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttat

SEQ ID NO: 155358 - DNA, 855 bp, Homo sapiens
  Payload ID: 10544
  Gene Symbol: MORF4L1
  Gene Name: mortality factor 4 like 1
  Uniprot ID: Q9UBU8
  ENST ID: ENST00000558502
  CDS Start-End: 138-845
caggacccgaagcctaaattccaggaggttgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactct

SEQ ID NO: 155359 - DNA, 874 bp, Homo sapiens
  Payload ID: 10544
  Gene Symbol: MORF4L1
  Gene Name: mortality factor 4 like 1
  ENST ID: ENST00000558746
  CDS Start-End: 65-874
gtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcagaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtaa

SEQ ID NO: 155360 - DNA, 680 bp, Homo sapiens
  Payload ID: 10544
  Gene Symbol: MORF4L1
  Gene Name: mortality factor 4 like 1
  ENST ID: ENST00000559690
  CDS Start-End: 342-680
cagagtggtgggtggggacagaaaaaaaaaagtgagatgagcgttttcctccgctttgtgttgcctggaggcatcactctgctattcttgggcgcagtgccgagatcctatggtaatgtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaag

SEQ ID NO: 155361 - DNA, 793 bp, Homo sapiens
  Payload ID: 10544
  Gene Symbol: MORF4L1
  Gene Name: mortality factor 4 like 1
  ENST ID: ENST00000559158
  CDS Start-End: 325-793
gccgagatcctatggtaatgtgagtgagctctcgctttgcagttgctcgtaaaaagtaaataaaaatgatctgaatgcagtgttgacgccgtttgcatttgtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaa

SEQ ID NO: 155362 - DNA, 761 bp, Homo sapiens
  Payload ID: 10544
  Gene Symbol: MORF4L1
  Gene Name: mortality factor 4 like 1
  ENST ID: ENST00000560422
  CDS Start-End: 26-761
aaaatactagggcctcgtagctagaatggaggtcacagggcctcggtttcagtgcacttttttttccggcagtagcagccaaggggagaaaaatggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctata

SEQ ID NO: 155363 - DNA, 616 bp, Homo sapiens
  Payload ID: 10544
  Gene Symbol: MORF4L1
  Gene Name: mortality factor 4 like 1
  ENST ID: ENST00000558830
  CDS Start-End: 261-616
tcgggggtggtgggagaaggaggaggcggcgaatcacttataaatggcgccgaagcaggacccgaagcctaaattccaggaggtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacac

SEQ ID NO: 155364 - DNA, 639 bp, Homo sapiens
  Payload ID: 10544
  Gene Symbol: MORF4L1
  Gene Name: mortality factor 4 like 1
  ENST ID: ENST00000559751
  CDS Start-End: 1-639
ctcttctttatgaagcaaagtgtgtaaaggttgccataaaggacaaacaagtgaaatacttcatacattacagtggttggaataaaaatgctgtgaggcccaggcgctctgaaaaatctttgaagacacatgaggatattgtagccctttttcctgttcctgaaggagctccctcagtacaccaccccctcctgacctctagttgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatg

SEQ ID NO: 155365 - DNA, 582 bp, Homo sapiens
  Payload ID: 10544
  Gene Symbol: MORF4L1
  Gene Name: mortality factor 4 like 1
  ENST ID: ENST00000559244
  CDS Start-End: 408-582
gtacgatatttcactgagtaaaagggttggaagcagagatacaagtggagagtaaaggtcctcaacttagaaaaacagatgaggaaagcatttaaaaaactgtattttcagatatatagttaaaaccaaccaaccaaccaacctcgacagctttgcaggagagtccgcttatgtgcttaacaggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatg

SEQ ID NO: 155366 - DNA, 678 bp, Homo sapiens
  Payload ID: 10544
  Gene Symbol: MORF4L1
  Gene Name: mortality factor 4 like 1
  ENST ID: ENST00000559930
  CDS Start-End: 457-678
ggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagtgtgcgcctttgggaaaaaggcacctaacggcgcaggagatagaggcgggctcgaggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaa

SEQ ID NO: 155367 - DNA, 1824 bp, Homo sapiens
  Payload ID: 10545
  Gene Symbol: MORF4L2
  Gene Name: mortality factor 4 like 2
  Uniprot ID: Q15014
  ENST ID: ENST00000360458
  CDS Start-End: 293-1159
gaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaagt

SEQ ID NO: 155368 - DNA, 1828 bp, Homo sapiens
  Payload ID: 10545
  Gene Symbol: MORF4L2
  Gene Name: mortality factor 4 like 2
  Uniprot ID: Q15014
  ENST ID: ENST00000441076
  CDS Start-End: 306-1172
cacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttc

SEQ ID NO: 155369 - DNA, 849 bp, Homo sapiens
  Payload ID: 10545
  Gene Symbol: MORF4L2
  Gene Name: mortality factor 4 like 2
  ENST ID: ENST00000418819
  CDS Start-End: 319-849
gcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatgttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatat

SEQ ID NO: 155370 - DNA, 1983 bp, Homo sapiens
  Payload ID: 10545
  Gene Symbol: MORF4L2
  Gene Name: mortality factor 4 like 2
  Uniprot ID: Q15014
  ENST ID: ENST00000422154
  CDS Start-End: 456-1322
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 155371 - DNA, 869 bp, Homo sapiens
  Payload ID: 10545
  Gene Symbol: MORF4L2
  Gene Name: mortality factor 4 like 2
  ENST ID: ENST00000442614
  CDS Start-End: 396-869
acctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaatt

SEQ ID NO: 155372 - DNA, 562 bp, Homo sapiens
  Payload ID: 10545
  Gene Symbol: MORF4L2
  Gene Name: mortality factor 4 like 2
  ENST ID: ENST00000422355
  CDS Start-End: 361-562
ggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccc

SEQ ID NO: 155373 - DNA, 1830 bp, Homo sapiens
  Payload ID: 10545
  Gene Symbol: MORF4L2
  Gene Name: mortality factor 4 like 2
  Uniprot ID: Q15014
  ENST ID: ENST00000451301
  CDS Start-End: 303-1169
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 155374 - DNA, 899 bp, Homo sapiens
  Payload ID: 10545
  Gene Symbol: MORF4L2
  Gene Name: mortality factor 4 like 2
  ENST ID: ENST00000434230
  CDS Start-End: 367-899
tatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgc

SEQ ID NO: 155375 - DNA, 1965 bp, Homo sapiens
  Payload ID: 10545
  Gene Symbol: MORF4L2
  Gene Name: mortality factor 4 like 2
  Uniprot ID: Q15014
  ENST ID: ENST00000433176
  CDS Start-End: 438-1304
aaaatcccagaatcccagggaccaaacagccaatcctttgctgggatttggcggcatctagtggcagactcgagaggtataaaccttactcacagaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 155376 - DNA, 717 bp, Homo sapiens
  Payload ID: 10545
  Gene Symbol: MORF4L2
  Gene Name: mortality factor 4 like 2
  ENST ID: ENST00000423833
  CDS Start-End: 4-717
aaaatgagaggggcctcctcaggaaagaagacagctggtccacagcagaaaaatcttgaatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtga

SEQ ID NO: 155377 - DNA, 784 bp, Homo sapiens
  Payload ID: 10546
  Gene Symbol: MOSPD1
  Gene Name: motile sperm domain containing 1
  Uniprot ID: Q9UJG1
  ENST ID: ENST00000370777
  CDS Start-End: 102-746
attgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtaaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtctt

SEQ ID NO: 155378 - DNA, 773 bp, Homo sapiens
  Payload ID: 10546
  Gene Symbol: MOSPD1
  Gene Name: motile sperm domain containing 1
  Uniprot ID: Q9UJG1
  ENST ID: ENST00000370779
  CDS Start-End: 148-627
ggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaatt

SEQ ID NO: 155379 - DNA, 2364 bp, Homo sapiens
  Payload ID: 10546
  Gene Symbol: MOSPD1
  Gene Name: motile sperm domain containing 1
  Uniprot ID: Q9UJG1
  ENST ID: ENST00000370783
  CDS Start-End: 188-829
cccagcaggcagtgcagcctagagacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttca

SEQ ID NO: 155380 - DNA, 4163 bp, Homo sapiens
  Payload ID: 10547
  Gene Symbol: MOSPD2
  Gene Name: motile sperm domain containing 2
  Uniprot ID: Q8NHP6
  ENST ID: ENST00000380492
  CDS Start-End: 89-1645
gggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaa

SEQ ID NO: 155381 - DNA, 1870 bp, Homo sapiens
  Payload ID: 10547
  Gene Symbol: MOSPD2
  Gene Name: motile sperm domain containing 2
  ENST ID: ENST00000482354
  CDS Start-End: 75-1535
ggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaatttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaa

SEQ ID NO: 155382 - DNA, 605 bp, Homo sapiens
  Payload ID: 10547
  Gene Symbol: MOSPD2
  Gene Name: motile sperm domain containing 2
  ENST ID: ENST00000460386
  CDS Start-End: 1-474
agcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaagggagatatacctaatgctaaatgacgagttaatgggtgcagcacaccaacatggcacatgtatacatatgtaacaaacctgcacgttgtgcacatgtaccctaaaacttaaagtataataaaaataaaaaaaataaaaataaaaataaaaataaa

SEQ ID NO: 155383 - DNA, 775 bp, Homo sapiens
  Payload ID: 10547
  Gene Symbol: MOSPD2
  Gene Name: motile sperm domain containing 2
  ENST ID: ENST00000497603
  CDS Start-End: 1-120
atggcagagaatcacgcccagaataaagccaagctcatctctgagacccggaggaggttcgaagctgagtatgtgacaggtgggtactctgttccaggtattaagaaaggtgtgcagtgagcatccccaactttgctggagtgtttgtgagtgtatttgtgggaggtgttagggaccctttcgaccctcacaggaatgatgctgggcacgtctcaaaggttttcctctccatgacaagccgtgtgcactgcttcaaatggtcaagtggtgtgtcccatgctccctttaaagggttaatgtaagttggaaatcggttaagtttttagcatgccctcgtgtttatggaacttgcaggatacttgttaggcccacaacacgggtgacattgtccagtccacggttccactgctggcctttcaccagcaacactagcgaaaatgtacctggaaactgccataatactattgatgtgtacttaattgggtatacaaattccttggatattttgtttgatttggctttcatacaacccagcatgctacccacaaaataggccctccaatgctggaacaagttcttatcccaaactgtatcttgcaaagtacctatgagtccagaattgatttattggttgaacattctgtgtccagatgtcacagatacttgagttgtcaggtacttaactgaatatttaatgcttgtacagtaattttgtaaaacatacggaataacttattgtaaatatggaattaaataaggatttatatgttgccta

SEQ ID NO: 155384 - DNA, 1053 bp, Homo sapiens
  Payload ID: 10548
  Gene Symbol: MOSPD3
  Gene Name: motile sperm domain containing 3
  Uniprot ID: O75425
  ENST ID: ENST00000223054
  CDS Start-End: 203-910
atcggcgtatagttacggcagaaacaaagacgtcctagccaatgacagaggccgtacggcggaagtatagaaaaggactctctggaacatggcaacattaatctgaccacaagctgactggcaggtgctttaaccacaagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccag

SEQ ID NO: 155385 - DNA, 1016 bp, Homo sapiens
  Payload ID: 10548
  Gene Symbol: MOSPD3
  Gene Name: motile sperm domain containing 3
  Uniprot ID: O75425
  ENST ID: ENST00000379527
  CDS Start-End: 119-826
cccggaaggggcgaggccagcggcggggcggggcttatggagatcgtgagctgggcctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatg

SEQ ID NO: 155386 - DNA, 1191 bp, Homo sapiens
  Payload ID: 10548
  Gene Symbol: MOSPD3
  Gene Name: motile sperm domain containing 3
  Uniprot ID: O75425
  ENST ID: ENST00000393950
  CDS Start-End: 283-990
ctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaa

SEQ ID NO: 155387 - DNA, 1115 bp, Homo sapiens
  Payload ID: 10548
  Gene Symbol: MOSPD3
  Gene Name: motile sperm domain containing 3
  Uniprot ID: O75425
  ENST ID: ENST00000424091
  CDS Start-End: 237-914
ggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacatccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaa

SEQ ID NO: 155388 - DNA, 853 bp, Homo sapiens
  Payload ID: 10548
  Gene Symbol: MOSPD3
  Gene Name: motile sperm domain containing 3
  ENST ID: ENST00000493970
  CDS Start-End: 177-853
ggcgcccgctgcagcgggcggagtctggctggagagaggaggcgggcgtccgggaacgcccggaaggggcgaggccagcggcggggcggggcttatggagatcgtgagctgggcctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttggg

SEQ ID NO: 155389 - DNA, 979 bp, Homo sapiens
  Payload ID: 10548
  Gene Symbol: MOSPD3
  Gene Name: motile sperm domain containing 3
  ENST ID: ENST00000462372
  CDS Start-End: 147-356
cggcggaagtatagaaaaggactctctggaacatggcaacattaatctgaccacaagctgactggcaggtgctttaaccacaagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaa

SEQ ID NO: 155390 - DNA, 527 bp, Homo sapiens
  Payload ID: 10549
  Gene Symbol: MLN
  Gene Name: motilin
  Uniprot ID: P12872
  ENST ID: ENST00000266003
  CDS Start-End: 58-402
gaagacaagcagagagactcctccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgagtgagatgcttccccagcatgccaagtgatggccacgctggggagaaggtggacagatttgggaggcccctcctgcccaagtgaggccctgggaatttacagagcctgccagctgggcttggaaggaaaacaccctttccaaagcaaattcccc

SEQ ID NO: 155391 - DNA, 566 bp, Homo sapiens
  Payload ID: 10549
  Gene Symbol: MLN
  Gene Name: motilin
  Uniprot ID: P12872
  ENST ID: ENST00000430124
  CDS Start-End: 67-414
cggacaccagaagacaagcagagagactcctccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgagtgagatgcttccccagcatgcagccaagtgatggccacgctggggagaaggtggacagatttgggaggcccctcctgcccaagtgaggccctgggaatttacagagcctgccagctgggcttggaaggaaaacaccctttccaaagcaaattcccctccagcaaataaagcatgaaatataca

SEQ ID NO: 155392 - DNA, 400 bp, Homo sapiens
  Payload ID: 10549
  Gene Symbol: MLN
  Gene Name: motilin
  Uniprot ID: P12872
  ENST ID: ENST00000507738
  CDS Start-End: 36-362
ccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgacagccaagtgatggccacgctggggagaaggtggacagatttgggaggc

SEQ ID NO: 155393 - DNA, 1239 bp, Homo sapiens
  Payload ID: 10550
  Gene Symbol: MLNR
  Gene Name: motilin receptor
  Uniprot ID: O43193
  ENST ID: ENST00000218721
  CDS Start-End: 1-1239
atgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgctggtggtggttctggcatttataatttgctggttgcccttccacgttggcagaatcatttacataaacacggaagattcgcggatgatgtacttctctcagtactttaacatcgtcgctctgcaacttttctatctgagcgcatctatcaacccaatcctctacaacctcatttcaaagaagtacagagcggcggcctttaaactgctgctcgcaaggaagtccaggccgagaggcttccacagaagcagggacactgcgggggaagttgcaggggacactggaggagacacggtgggctacaccgagacaagcgctaacgtgaagacgatgggataa

SEQ ID NO: 155394 - DNA, 2174 bp, Homo sapiens
  Payload ID: 10551
  Gene Symbol: MNX1
  Gene Name: motor neuron and pancreas homeobox 1
  Uniprot ID: P50219
  ENST ID: ENST00000252971
  CDS Start-End: 302-1507
gcggcctccgcgcggtcgcctgagggctgcagcgcaaagaaccgggctcccgggcccggacgcggggaagcactcgcgtgggagtttgtgcgagcgcggcccggggcggggcccgcacggaggaggcgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgatggaaaaatccaaaaatttccgcatcgacgccctgctggcggtggaccccccacgagccgcctctgcgcagagcgcgccgctggccttggtcacgtcgctcgccgccgccgcatctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggcacgggcggcgggcacggggggccccaccaccacgcgcatccgggcgcagcggccgctgccgccgccgccgccgccgccgccgccgctgggggcctggcgctggggctgcaccctgggggcgcgcagggcggcgcgggcctcccggcgcaggcggcgctctacggccacccggtctacggctactccgcggcggcggcggcggctgcgctggcgggccagcacccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggat

SEQ ID NO: 155395 - DNA, 631 bp, Homo sapiens
  Payload ID: 10551
  Gene Symbol: MNX1
  Gene Name: motor neuron and pancreas homeobox 1
  ENST ID: ENST00000428439
  CDS Start-End: 384-631
tctcttaacgggaaggggcagttggaggtgtgagactgagatctaatgattaacccgaaggctgcaggagaaggaagtcgccgggggaaggcgagccgagagcgccctgaattaggcaggcccgggaatgggggtcagggcttatcaccggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaagcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaa

SEQ ID NO: 155396 - DNA, 322 bp, Homo sapiens
  Payload ID: 10551
  Gene Symbol: MNX1
  Gene Name: motor neuron and pancreas homeobox 1
  ENST ID: ENST00000425745
  CDS Start-End: 236-322
cggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaaggtgaagatttggttccagaaccggcggatgaa

SEQ ID NO: 155397 - DNA, 1620 bp, Homo sapiens
  Payload ID: 10551
  Gene Symbol: MNX1
  Gene Name: motor neuron and pancreas homeobox 1
  Uniprot ID: P50219
  ENST ID: ENST00000543409
  CDS Start-End: 384-953
tctcttaacgggaaggggcagttggaggtgtgagactgagatctaatgattaacccgaaggctgcaggagaaggaagtcgccgggggaaggcgagccgagagcgccctgaattaggcaggcccgggaatgggggtcagggcttatcaccggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaagcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggat

SEQ ID NO: 155398 - DNA, 1101 bp, Homo sapiens
  Payload ID: 10551
  Gene Symbol: MNX1
  Gene Name: motor neuron and pancreas homeobox 1
  ENST ID: ENST00000474448
  CDS Start-End: 384-815
tctcttaacgggaaggggcagttggaggtgtgagactgagatctaatgattaacccgaaggctgcaggagaaggaagtcgccgggggaaggcgagccgagagcgccctgaattaggcaggcccgggaatgggggtcagggcttatcaccggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaaggtaacgaatgcccctccaaggtggggccgagggagcccctgttctccccaccccagagccgctgggcttcgggcagcttcctctccatccgggcgggacacctcgccagaggcctgggcccctcaggctttcctggcacacgcggactctccgggctggggctccggggctctggctctctggggctctggctctccccgctcgccccatcggggtcagctacttatgagtcgggccgagcagatgtatatggctcaacgctttcagccgccgaacacccaaacaaagagaccccattgtttctgtctgagtggatttgtttagactggggagatgcaggcagagcaggggaaaagcaaaaaagaaaacagaaataaacactccagaattcagattcctttgctggaagctgtggttgtgactaaacagagaaaatctaggaccccagaggctggagaagtcacaagaggcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaa

SEQ ID NO: 155399 - DNA, 169 bp, Homo sapiens
  Payload ID: 10551
  Gene Symbol: MNX1
  Gene Name: motor neuron and pancreas homeobox 1
  ENST ID: ENST00000479817
  CDS Start-End: 1-94
cgcgggcatgatcctgcctaagatgcccgacttcaactgtaaagaaggcacagacaccctcacctcctgcactctaggcagcttccagaattgactaaaaatatcccgagagctttccaggaagccgcagggagccctcgacctgtttgaatctctggctgccggtgga

SEQ ID NO: 155400 - DNA, 209 bp, Homo sapiens
  Payload ID: 10551
  Gene Symbol: MNX1
  Gene Name: motor neuron and pancreas homeobox 1
  ENST ID: ENST00000469500
  CDS Start-End: 24-134
aggtggcctggcttgaaccagctatggggggactctcaacagtaggtgcctgccctggaatcctgggcgcccaacaaggtaaagaaggcacagacaccctcacctcctgcactctaggcagcttccagaattgactaaaaatatcccgagagctttccaggaagccgcagggagccctcgacctgtttgaatctctggctgccggtgga

SEQ ID NO: 155401 - DNA, 3383 bp, Homo sapiens
  Payload ID: 10552
  Gene Symbol: MOV10
  Gene Name: Mov10 RISC complex RNA helicase
  Uniprot ID: Q9HCE1
  ENST ID: ENST00000357443
  CDS Start-End: 169-3180
aggagggaagcctggtggggagaagggagcccgcaggatcaggggtcagagttagggggcttccctcctgctgcaccctcatctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaact

SEQ ID NO: 155402 - DNA, 4100 bp, Homo sapiens
  Payload ID: 10552
  Gene Symbol: MOV10
  Gene Name: Mov10 RISC complex RNA helicase
  ENST ID: ENST00000369644
  CDS Start-End: 1030-3873
gataggacgaagaaaccgaagggaaagctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagtcttgcctccagcaaatccatcctccaatcctgatgccagagtgatctgaaatgcaaatatgatcttgccactcccctgcttaaaacccaccaaccgcagtggttctgtaaccacagtgtagcctctgacgtgggctgaaagcacaaagccaggctatttgatctctggagaaggatcctttcccttcctgcttgggttccacctgcaccctatgacttcgggtggaaactgctgtctgatcagccaccttgcccacacacttggacatctgtactgtctctgatcccttctctcctcaccaacaggctggaccccacatccacccctctgaatcaaatcattccgcttccccttagcctcagctctttcttctgggttgtttgtattttcttttctgtcccaaacagtttcccccacaaaaagaactttatgtctttctctgtcttccctcagtccttccagtcagcagcctgtgattgggcttttcccctcagaaacgaacaatccagaacccactgtttaaaacaactgtattttgccttgggaagtcccattgccttccctgaaaacattaaacattcctccgatccccagcctgagtctctctgtctctgggccccatcctgctccacagcagggctggtgtgtccagcacagagtgaccctccgatgccctttcccacccgccgccctgcctccctcgagccctgccttccctcacttcccagtctcctctgcttctggcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatg

SEQ ID NO: 155403 - DNA, 3552 bp, Homo sapiens
  Payload ID: 10552
  Gene Symbol: MOV10
  Gene Name: Mov10 RISC complex RNA helicase
  Uniprot ID: Q9HCE1
  ENST ID: ENST00000369645
  CDS Start-End: 309-3320
gcttttcactgagtcccgaggctctggagggtgggcgtgagggtagccctggctgaggctcggaggtcctcccgggctgttcagagggccccaagcggtagccacgttctgatactggctagaagccaggggagggagcttggggtaaggggagggccctgagggaggggtcagacgctttaggaaagagttaatgcgaagagggggaggggataggacgaagaaaccgaagggaaagctcagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaa

SEQ ID NO: 155404 - DNA, 3641 bp, Homo sapiens
  Payload ID: 10552
  Gene Symbol: MOV10
  Gene Name: Mov10 RISC complex RNA helicase
  Uniprot ID: Q9HCE1
  ENST ID: ENST00000413052
  CDS Start-End: 391-3402
cgctggatgagcttccccattccggccgcagccgacctagatcccagccctgccctttgctctcctgcttttcactgagtcccgaggctctggagggtgggcgtgagggtagccctggctgaggctcggaggtcctcccgggctgttcagagggccccaagcggtagccacgttctgatactggctagaagccaggggagggagcttggggtaaggggagggccctgagggaggggtcagacgctttaggaaagagttaatgcgaagagggggaggggataggacgaagaaaccgaagggaaagctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaagccttga

SEQ ID NO: 155405 - DNA, 3960 bp, Homo sapiens
  Payload ID: 10553
  Gene Symbol: MOV10L1
  Gene Name: Mov10 RISC complex RNA helicase like 1
  Uniprot ID: Q9BXT6
  ENST ID: ENST00000262794
  CDS Start-End: 84-3719
attggtggcgggcggcgggagcggcgcgggcgcgtgcgggcggcggcagcggcggtgacggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccagaa

SEQ ID NO: 155406 - DNA, 1701 bp, Homo sapiens
  Payload ID: 10553
  Gene Symbol: MOV10L1
  Gene Name: Mov10 RISC complex RNA helicase like 1
  Uniprot ID: Q9BXT6
  ENST ID: ENST00000354853
  CDS Start-End: 306-683
agacgctgcgtgcaaagcactgggtgctgatgtggcttagcatctcctgacacctgtggcctgtcctccctccagccgggtgacacccagacccccagctcctgcacacccctgggcaaccctgctgtgcccccggggtgctgagcgtggctttgccagtgtgtcagaggcatcaattgctaaaacaattcggcagaaattaccatttagaacatctttgctctagagttgggcacttcactcacgtgtttgtggacgaggctgggcaggcaagtgagccggaatgcctcattcctctggggctgatgtcggacatcagtggccaggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtacgccctgcccaggcacgcctggttctgtgaggtccctgcagccctgctccttggctcctgcagctccacagaggcaggaacaagctccttgtgagcagcagcaggtttttaaaggggcaggaccgcacttgaatgtcgttcaacatgagaggtcacccaactgccatccatgggccagttccgggcagctgccagcttttctacggccagagcctcgaacagtttttacatttctaaatggttacatttatatgtcccttgatatttggccctttgggaaaacatttgccaacccccagctctaacccagtgtttctcaaagggggcactttgggtatatttgaatgggacgcttctcatttcgtatgactctgtgatgtgattataggagagttagcgtccccaggccccaggggctggtcccaggaagcatctccacacgttcacagtggctctggagctctggtggggacacaggtgcctcccatgccgaacaccaggtttcattcatgaagcatgtgtccctgtggtgttcacaccaccaagcagaacttggaaagaacccccaaaatacagaagaaaaggtgagtcccctaggccatcacagtaacagatcacctgtaccgcgcgtgtgctgaccgcagagcccgtcaaagatgttatgtttccttttttctgacctcggggactcgagaggtgagtgcttagttctcccagaggtacagagattacgaaggcttatggagacaagtaagttgccagacatcacacagccagtgtcctggtgtcttaacctcagcttgtaggtgccatcctgctgagacatccagcttagagctgccatcctcagctctaagcatcagacatgcatctcgtttctcctgaaggatttcctccatccttgatatgtgcttgtggggagggaggattttccacatgaaacttggctttcctagtaagcattgtcccccgtccccagtttaactaaaactgcaatttgtgttctaatcaattcagattagaagaaagcaataaagaattaaaaaac

SEQ ID NO: 155407 - DNA, 1422 bp, Homo sapiens
  Payload ID: 10553
  Gene Symbol: MOV10L1
  Gene Name: Mov10 RISC complex RNA helicase like 1
  Uniprot ID: Q9BXT6
  ENST ID: ENST00000395852
  CDS Start-End: 178-1194
gagagccgtgtgtggctaccggattggacagcacggatctgaacaagacagggattttttttgttaatgtgtgttgatgagtcaaaggtcaagagccgaagagccagtcctcactggggtgcagagggctctttgggggcagagcgggcactgcatggaccctgcaccctggagctgatgttcagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcga

SEQ ID NO: 155408 - DNA, 1044 bp, Homo sapiens
  Payload ID: 10553
  Gene Symbol: MOV10L1
  Gene Name: Mov10 RISC complex RNA helicase like 1
  ENST ID: ENST00000395854
  CDS Start-End: 36-206
gcggcggtgacggcagcctaggccgggcgagggccatgctgagcctcgcagccaagctggtggccttcttctggaggacggcggacacccctagggaggaagccgggcagctggagcccgagctcgcggaaggtggctcgcgggaggcggctgggaggcgggtcccgggccctcgcgtgtcggccacgagggagccgcgcccataggtctttgagtgcagtgcgggccggcaggcaacgctgggcccggcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctccatgtcgttcctccctgtccgcagcgtcattggcggtggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtagcgtgccgactagtggctcctctctgtgcttctggcagacctgccatcaggggtaacttgcacggcccaggcttctcctgcatgtgttggaagcctggaaaaataaagctttgtcatggccaaa

SEQ ID NO: 155409 - DNA, 3763 bp, Homo sapiens
  Payload ID: 10553
  Gene Symbol: MOV10L1
  Gene Name: Mov10 RISC complex RNA helicase like 1
  Uniprot ID: Q9BXT6
  ENST ID: ENST00000395858
  CDS Start-End: 25-3522
ggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccagaa

SEQ ID NO: 155410 - DNA, 937 bp, Homo sapiens
  Payload ID: 10553
  Gene Symbol: MOV10L1
  Gene Name: Mov10 RISC complex RNA helicase like 1
  ENST ID: ENST00000434497
  CDS Start-End: 1-500
aaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgatt

SEQ ID NO: 155411 - DNA, 2003 bp, Homo sapiens
  Payload ID: 10553
  Gene Symbol: MOV10L1
  Gene Name: Mov10 RISC complex RNA helicase like 1
  ENST ID: ENST00000419054
  CDS Start-End: 45-215
gcggcggcagcggcggtgacggcagcctaggccgggcgagggccatgctgagcctcgcagccaagctggtggccttcttctggaggacggcggacacccctagggaggaagccgggcagctggagcccgagctcgcggaaggtggctcgcgggaggcggctgggaggcgggtcccgggccctcgcgtgtcggccacgagggagccgcgcccataggtctttgagtgcagtgcgggccggcaggcaacgctgggcccggcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctccatgtcgttcctccctgtccgcagcgtcattggcggtggtgtgtctagaaagccccgaaaaacgcggccccgcagacttggcctgtcctttcagaacgcgctgcgccaaggcgtgccatttccttgtctggttttcaagcccatctttctaaagcccgggatgcgcccggatgccctcaccgttcctttctcctgaggtgtttgtgtgtgtgtgtgtgtgagacggagtttcgctcttgttgcccaggctggagtgcagtggcgcaatctcggctcaccgcaacctccgccttctgggttcaagtgattctcctgcctcagcctcccgagcagcggggattataggcacccgccaccacgcccggctaatttttgtatttttagtcgagggggggttcgccatgttggtcaggctggtctcgaactcctgatctcaggtgacccacccaccttggcctcccaaagtgctgggattacaggcttgagccaccacgcccgacctctcccgaggttctgatggcttctcccgatgtttccttatgtgggaatggaatccacagtagtgggtccctaattgccttctgtgagaaaagacaggaacaggcttcaggaggggagcttcctgctgcaggcagcgtgttcagggcctctggatccacgagggccgatgcccggggggccggctgtgttacctggagcacttgctccgtggatctcttcggtagaacacgcgctcagcggtagctggagctccagctcttggcagcgctcagatcctatgcctgtactgtaaccgtcgccccaggttcctcccgtggctgggaagctgcagtaaaggcacgttcaggactcaggaccgtggctgcagcagtggccagacggctgagggcgtgcgctgctcctgggccagacttgtctgcccagccccgaaccttttccagcaccgtgtttgttgagattctccagtcttccgaggctgctgctgatggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtagcgtgccgactagtggctcctctctgtgcttctggcagacctgccatcaggggtaacttgcacggcccaggcttctcctgcatgtgttggaagcctggaaaaataaagctttgtcatggccaaa

SEQ ID NO: 155412 - DNA, 3941 bp, Homo sapiens
  Payload ID: 10553
  Gene Symbol: MOV10L1
  Gene Name: Mov10 RISC complex RNA helicase like 1
  Uniprot ID: Q9BXT6
  ENST ID: ENST00000540615
  CDS Start-End: 221-3718
ataggtctttgagtgcagtgcgggccggcaggcaacgctgggcccggcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctccatgtcgttcctccctgtccgcagcgtcattggcggtggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgaccccc

SEQ ID NO: 155413 - DNA, 3889 bp, Homo sapiens
  Payload ID: 10553
  Gene Symbol: MOV10L1
  Gene Name: Mov10 RISC complex RNA helicase like 1
  Uniprot ID: Q9BXT6
  ENST ID: ENST00000545383
  CDS Start-End: 85-3720
atgacgtcactcccaccaggcacctcgccttgtcaggagctgccaggcagcggcggtgacggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcata

SEQ ID NO: 155414 - DNA, 2484 bp, Homo sapiens
  Payload ID: 10554
  Gene Symbol: MPHOSPH10
  Gene Name: M-phase phosphoprotein 10 (U3 small nucleolar ribonucleoprotein)
  Uniprot ID: O00566
  ENST ID: ENST00000244230
  CDS Start-End: 353-2398
aggtcaggggcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgctcgcgctgccattggctctggctgagggcgagtccggaacctgtgcgccgcggaactttcggctctgaaatccaagttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 155415 - DNA, 2068 bp, Homo sapiens
  Payload ID: 10554
  Gene Symbol: MPHOSPH10
  Gene Name: M-phase phosphoprotein 10 (U3 small nucleolar ribonucleoprotein)
  ENST ID: ENST00000498451
  CDS Start-End: 35-1423
gcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatgggtatggtgccctcttctgtagttttcatgtctgtgctttttccatggttccatttcatacaaagatttggggtggtgtttcttttccctcaactttttattttaaaaacttgtaaacacatggcttggcatggtagctcacacctgtaatcccggcactttgggaggccgaggcagacggatcacctgaggtcaggagtttgagaccagcctggccaacatggtgaaaccccgtctctactaaaaatacaaaaatcagccagatacggtggcagatttcagaatcccatctactcggaaggctgaggcaggagaattgcttgaacccagaaaggggaggttgcagtgagccaaggttgtgccagtgtgctccagcgtgggcagcctgggcaacagagcgacactctgtcaaaaaagaaaaaatcaacttataaacacagaagagttgaaaaaatactacagtgaacacctatatgctattcaattggattcaccagttaccattttgttatatttgctttctctccctagcatatgtaagattgtatatgtgccctttttttaagtaagttgccaatctcatggcacttcacttttaagtacttttgcagatatcgtctaagaactaggacattctcctatgtaatcacagtaccattaatccacccaaaaaatttaacaatacgctaatgatacctaatgtatagtttgtaatcagctttcttgtagtaatctgttttgaaggcttgcatcctgtcatggtccactgattaaattttgaacttcaacctgaaa

SEQ ID NO: 155416 - DNA, 1103 bp, Homo sapiens
  Payload ID: 10555
  Gene Symbol: MPHOSPH6
  Gene Name: M-phase phosphoprotein 6
  Uniprot ID: Q99547
  ENST ID: ENST00000258169
  CDS Start-End: 52-534
gcatgtgcggtgaggctcgcggccggagtgcggcgctgggcggaagctaccatggcggccgagcgaaagacaaggttgtccaagaatctactgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatatttattatgtcaagccaattcgtacatacaatttggaatcaaatgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacata

SEQ ID NO: 155417 - DNA, 392 bp, Homo sapiens
  Payload ID: 10555
  Gene Symbol: MPHOSPH6
  Gene Name: M-phase phosphoprotein 6
  ENST ID: ENST00000569021
  CDS Start-End: 23-190
gcggcgctgggcggaagctaccatggcggccgagcgaaagacaaggttgtccaagaatctactgcgcatgaagtttatgcaaaggggactggactcagaaaccaagaaacaactagaagaagaagaaaagaaaatcattagtgaagagcactggtacttggatttgccagagcttaaagagaaagagtaggtttattaaaattgatactgatgatgcttgtggcattcagaaggaaactcctggtaaatttaactcatcattccggtgacataaagcccatgaaattgtttctgttcagtttattgatttagtagcacaactaaaaaatattaaacctatagaagttgtacatggatttatacatttttactactccccctcccagccacta

SEQ ID NO: 155418 - DNA, 723 bp, Homo sapiens
  Payload ID: 10555
  Gene Symbol: MPHOSPH6
  Gene Name: M-phase phosphoprotein 6
  ENST ID: ENST00000563100
  CDS Start-End: 163-591
cgctgggcggaagctaccatggcggccgagcgaaagacaaggttgtccaagaatctactgcgcatgaagtcatcatattgggacagatgaaggagatgacccagacacccagtccttaaggtctccagaaaagatagatgctcagaaagttcagatgtgtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatgataagtacctaggacttctgagaactactgatttaatttcgctcccaggaagtgaatgag

SEQ ID NO: 155419 - DNA, 617 bp, Homo sapiens
  Payload ID: 10555
  Gene Symbol: MPHOSPH6
  Gene Name: M-phase phosphoprotein 6
  ENST ID: ENST00000563504
  CDS Start-End: 107-502
ggcgctgggcggaagctaccatggcggccgagcgaaagacaaggttgtccaagaatctactgcgcatgaaggtgcggggacgctgagagcgccactccgggcgtttatgcaaaggggactggactcagaaaccaagaaacaactagaagaagaagaaaagaaaatcattagtgaagagcactggagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaaga

SEQ ID NO: 155420 - DNA, 432 bp, Homo sapiens
  Payload ID: 10555
  Gene Symbol: MPHOSPH6
  Gene Name: M-phase phosphoprotein 6
  ENST ID: ENST00000568016
  CDS Start-End: 41-334
gaggctcgcggccggagtgcggcgctgggcggaagctaccatggcggccgagcgaaagacaaggttgtccaagaatctactgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgaggtgtttctccaccaggtaccatttctactcattatatagaaaataacaagtcttgaaatatcgccatagctatttaaagaaattggaggcattgcagtctagttttatggtagagaaattgatgcttcagatgaatg

SEQ ID NO: 155421 - DNA, 4235 bp, Homo sapiens
  Payload ID: 10556
  Gene Symbol: MPHOSPH8
  Gene Name: M-phase phosphoprotein 8
  Uniprot ID: Q99549
  ENST ID: ENST00000361479
  CDS Start-End: 69-2651
ggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcactgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaaaaaaaaaaaaaggaaaaattcagctctaaaacatttgcttacagcaagggagccatgttatattcaagttacccaagcaccaaataaagtgtgggtttgctgcccttgaaagggttgggaggcctgatctttttctagtagacagttgccacacattccccaagcacaaaaggtggagatggcagtcactttgtaaatatgctgtagtcacttatcatcttttcaaagggtaacaagagaatctaagatgtagtaagaatgtaaaccagtacactatgagacctaaaagagagtattaaatgtgaacttttagcagagcgtggtggctcacacctataatcccagcgctttggaggctgaggttggaggattgcttaagtccaggagttcaagaccagcctgggtaacatggggtggaacaagcctgtagtcccagatactcaggaggctgaggtgaaaggattgcttgagccagggaggtcaaggctgcagtgagccgtgaaaggccactgcactccagcctgagtgacagaatgagaccttgtctcaaaaaaaaaaaaaagtttcttggaacctatacggtttttttttgttttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 155422 - DNA, 717 bp, Homo sapiens
  Payload ID: 10556
  Gene Symbol: MPHOSPH8
  Gene Name: M-phase phosphoprotein 8
  ENST ID: ENST00000449056
  CDS Start-End: 1-452
cagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctgacagggtctcgctctgttgtccaggctggagtgcagtggcgcggattacagctcactggagtcttgacttcccaggcacaagcaatcctcccacctcagcctcctaactacctgggactaaaaatgacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgt

SEQ ID NO: 155423 - DNA, 1048 bp, Homo sapiens
  Payload ID: 10556
  Gene Symbol: MPHOSPH8
  Gene Name: M-phase phosphoprotein 8
  ENST ID: ENST00000414242
  CDS Start-End: 1-934
aaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcaggtgagtttggaatcattttgcagaatttttcaaggtagtgcaccatattattttactgtactcttctctgtatttctgatctcaacgatcaaaaaataatggagtcgaagagtttatttggatctcctgaataaataacattttatattgaa

SEQ ID NO: 155424 - DNA, 3097 bp, Homo sapiens
  Payload ID: 10557
  Gene Symbol: MPHOSPH9
  Gene Name: M-phase phosphoprotein 9
  ENST ID: ENST00000302373
  CDS Start-End: 1-2523
gcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaaga

SEQ ID NO: 155425 - DNA, 1090 bp, Homo sapiens
  Payload ID: 10557
  Gene Symbol: MPHOSPH9
  Gene Name: M-phase phosphoprotein 9
  ENST ID: ENST00000539336
  CDS Start-End: 1-1090
accaggtggttacagctattcaatttggtggaaaaacaatgccaagaacagatagttgcccagcaggagcagttccacaaccaaattcaaaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttcc

SEQ ID NO: 155426 - DNA, 400 bp, Homo sapiens
  Payload ID: 10557
  Gene Symbol: MPHOSPH9
  Gene Name: M-phase phosphoprotein 9
  ENST ID: ENST00000537854
  CDS Start-End: 255-400
actggagagacgccgggcgcgcgcgcgctccctcgggtaacggtcgcgagaggccgcttgcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagtaatgctataacatcatgggcacaaaaactgaagcagaacca

SEQ ID NO: 155427 - DNA, 570 bp, Homo sapiens
  Payload ID: 10557
  Gene Symbol: MPHOSPH9
  Gene Name: M-phase phosphoprotein 9
  ENST ID: ENST00000541437
  CDS Start-End: 192-570
gaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaactgtgagaccaggtggttacagctattcaatttggtggaaaaacaatgccaagaacagatagttgcccagcaggagcagttccacaaccaaattcaaaacctgaaatacagcaagaaatgtccacgtc

SEQ ID NO: 155428 - DNA, 3414 bp, Homo sapiens
  Payload ID: 10557
  Gene Symbol: MPHOSPH9
  Gene Name: M-phase phosphoprotein 9
  ENST ID: ENST00000539024
  CDS Start-End: 1-2026
acaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggtgaaatgtcttagcttgaatctgctttagaggcttgatgccagtcagtgttccagttatctaagaggggtttaaaaaatcatggcacagtgaaaattagacacactgaagcagcagtcaaaacttttagcttttacgggaagtgtttgattatagcaattttataactgcaagctagctttcaggaataaaaattgattttacctttagacttagagaagaaggtgttcatgcccttgtattttcaagaaactaacttgagagcaaatggcaatatgcttttcaacagattttacactaagttagtgctcacagattgcctctctttttgtttgatttctccctcctcaaatctgtaatttatttctgaactcctttccattagcaagcagataaaatggttacactttggaaactgaatagctgtagaggttcaaaaagtgagccgtaggccgggcgcaggggctcacgcctataatcccagcactttgggaggctgaggctggtgtatcacctgaggtcaggagttccagccactgtgcccagcccccaacttctttttttctgactttgtctttttgttctgataaatattagtcaataatttataggctgggcgtggtggctcatgccggtaatcccagcactttgggaggctgatgcaggcgggtcacctgaggtcaggagttcgagaccagcctggcccacatggtgaaaccccgtctctactaaagtacaaaaattagccgggcatggtgtgggggtgggcgcctgtaattccagctactcgggaggctgaggcaggagaattgctcgaacctggaaggtggaggttgcagtgagccaagatggtgccactgcactccagcctgggtaatagagcaagactcagtcttaaaaaaaaaaaaaaataaactttcaattgaacttttcatgttatgaaatatctttctataacatccttttaaattaacgtacaatattccatcagcagtaacgtatttaaccaagaatgttttagtagaaatttgggttgcttctaattttggatatcataaataaggctgcaataaagttcttaaacata

SEQ ID NO: 155429 - DNA, 567 bp, Homo sapiens
  Payload ID: 10557
  Gene Symbol: MPHOSPH9
  Gene Name: M-phase phosphoprotein 9
  ENST ID: ENST00000535049
  CDS Start-End: 211-351
cgcgagaggccgcttgcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagggaagaccagaccatctgtaattcaaggtacagttgaagtcctaacttctttaatgcaagagctacaaaacagtggaaagactgattcggaactttggaaaaactgtgagaccaggtggttacagctattcaatttggtggaaaaacaatgccaagaacagatagttgcccagcaggagcagttccacaaccaaattcaacatatacaggaggagataaaaaatttagtcaaattacagactagtagtgcttc

SEQ ID NO: 155430 - DNA, 6136 bp, Homo sapiens
  Payload ID: 10557
  Gene Symbol: MPHOSPH9
  Gene Name: M-phase phosphoprotein 9
  ENST ID: ENST00000541076
  CDS Start-End: 83-3544
gaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaactgtgagcatatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcgtatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggagggctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaaccaagccatcccagttattccaagcaggctctcaaatgacctttgagcacccttcacctggctggtccccaggccaggggtccacagccctgctcccttctcagcaaggagggtggcctgtctgacagtgcagttgaacctttgctccctactctgcaacttttgaagacttcaggctaatcaaaattacttataattagaatcaagtgcctttattcttgttttttatttttattttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatcttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctcttcggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaaaagaaaaaaaaaaaaaaaa

SEQ ID NO: 155431 - DNA, 3634 bp, Homo sapiens
  Payload ID: 10557
  Gene Symbol: MPHOSPH9
  Gene Name: M-phase phosphoprotein 9
  ENST ID: ENST00000545556
  CDS Start-End: 196-465
gcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaactgtgagaatgtagagtaagcgaaatgaaagattacctggtttaagaattcgatagcagcaactgctaagtaccaggtggttacagctattcaatttggtggaaaaacaatgccaagaacagatagttgcccagcaggagcagttccacaaccaaattcaacatatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtaaagttgtccacattctgccgagtgaacgtgaacaatgcttcctgactctaacttttacctcaagcttcattttccctaggagatctaaagcctactcacttcaaaacaagcaaaacaaagccgagttctgagggattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaaga

SEQ ID NO: 155432 - DNA, 573 bp, Homo sapiens
  Payload ID: 10557
  Gene Symbol: MPHOSPH9
  Gene Name: M-phase phosphoprotein 9
  ENST ID: ENST00000545406
  CDS Start-End: 321-573
atccagcagatcactccacagctttgctcccagcctgtccacctcaccctcggtcaacttcccctgagcctgctgctgtctcttgagcccactgtgagatccagatagatacccactgaggaggaagcaggatggagacatgggatcaggcgttgctttcttactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaact

SEQ ID NO: 155433 - DNA, 856 bp, Homo sapiens
  Payload ID: 10557
  Gene Symbol: MPHOSPH9
  Gene Name: M-phase phosphoprotein 9
  ENST ID: ENST00000541603
  CDS Start-End: 1-647
caagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 155434 - DNA, 6351 bp, Homo sapiens
  Payload ID: 10557
  Gene Symbol: MPHOSPH9
  Gene Name: M-phase phosphoprotein 9
  Uniprot ID: Q99550
  ENST ID: ENST00000606320
  CDS Start-End: 208-3759
gagaggccgcttgcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgatagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaactgtgagaccaggtggttacagctattcaatttggtggaaaaacaatgccaagaacagatagttgcccagcaggagcagttccacaaccaaattcaacatatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcgtatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggagggctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaaccaagccatcccagttattccaagcaggctctcaaatgacctttgagcacccttcacctggctggtccccaggccaggggtccacagccctgctcccttctcagcaaggagggtggcctgtctgacagtgcagttgaacctttgctccctactctgcaacttttgaagacttcaggctaatcaaaattacttataattagaatcaagtgcctttattcttgttttttatttttattttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatcttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctcttcggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaaaagaaaaaaaaaaaaaaaa

SEQ ID NO: 155435 - DNA, 553 bp, Homo sapiens
  Payload ID: 10557
  Gene Symbol: MPHOSPH9
  Gene Name: M-phase phosphoprotein 9
  ENST ID: ENST00000606704
  CDS Start-End: 1-93
aaaaatgagagcagtccaattcgatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttg

SEQ ID NO: 155436 - DNA, 485 bp, Homo sapiens
  Payload ID: 10557
  Gene Symbol: MPHOSPH9
  Gene Name: M-phase phosphoprotein 9
  ENST ID: ENST00000606326
  CDS Start-End: 1-165
aatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaa

SEQ ID NO: 155437 - DNA, 662 bp, Homo sapiens
  Payload ID: 10557
  Gene Symbol: MPHOSPH9
  Gene Name: M-phase phosphoprotein 9
  ENST ID: ENST00000606321
  CDS Start-End: 1-492
agaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaagtaagagttagatgtgtacatctcttgggttcaaaagcgtgatctctgagtcaaatctatttgtgcccgctgcttgcctgtttctggtttctcttgtatcctcagcacctagtagagtactctgagcagaggacccctaaataagatcttgttcataaataaaattgtctgatcacataga

SEQ ID NO: 155438 - DNA, 7668 bp, Homo sapiens
  Payload ID: 10558
  Gene Symbol: MPLKIP
  Gene Name: M-phase specific PLK1 interacting protein
  Uniprot ID: Q8TAP9
  ENST ID: ENST00000306984
  CDS Start-End: 93-632
tggtaaaggactagcagttctctgcggagggccggttgatacagttccggtgggagaacgcggctgcgaggttttcggctttggctcctgatatgcagcgacagaattttcggcccccaactcctccttaccctggtccgggtggaggaggttggggtagcggaagcagcttccggggaaccccgggcgggggcggaccacggccgccctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccagggcagcagcagacccacccccagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttctagctattgtggttttgtggtatgataaagaagtagacttactacagtaatgctttgtagtcacttagagttcataggtaaatgttttgcaaattatttttgaaaatgaaataggtaaaccatcctttgagctgtagacagctctgtatttgttcgtaaataatgaggatgagaataacagagttctgttcatactcattttatctaatgcttctgttaaaatgcattaaaacttgaagccccagaaacccatttaagcataactttatactcatttaactggaaaaggcaagaatagaccatgcattgctaaatcaaagtgttctatctgaatttctctatacctcttagcattatggagttagtttctcttgaggccaaagaagatagctaccagcagcctcaaatcacttccattgcaaaaagaacatctctcatctccatcaatccaagagaagacaaatttgccatacttagatcatgtttctgtattattgaaccaattaactgtggccaaggccacagtgagacctaattaacttgaatcatggacacatcaccataatgagacaggattctgtgaccttgaacaccactgggcctacctggagtagagaagtggttttccaaattaagggatgctatggatatatacctatagttctggagagaaaaatatggaagaattgttaccccaactattttttaaaaatcaagtggttttttgtttgttttttgagatggagtctgttgcccaagctggagtgcagtggtgcaatcttggctcactgcaaccttcggctcctgagtagctgggactacaggcacatgtcaccatgcctggctaatttttgtatttttagtagagaccatgttttgttttttttgtttgttttgttttgtttttgaaatagggtctcactctgttgcccacgctggagtgcagtggcgcaatcttggctcactgcaacgtccgcctcccaggttcatacgagtctcccgcctcgacctcctgagtagctgggaatacaggcacgcgcctggctcatttttgtattttgaatagagatggggtttcaccgtgttggccaggctggtctcgattgaactcctggtctcaagtgatcccctaccttggcttcccaaagtgctgggatttcaggcatgagccaccgtgcccagcccagaacatgtatttttagtatttttagtatttttagtttcaccatgttgaccaggctggtctcgaactcatgatctcaaatgatccacccatctcagcctcccacagtgctgagtttacaggcgtgagccaccatgcccggccaaaatcaggtgttttaacatgtaacacagactctaggcattttgaagttacaaaatacgaagatagagctagtaaaacttttgtttcaacattcccagaaagaaacgtgtaaaaacaaaatggtcacacctcctatttgaaccatacccacagaaatttgttcattaggtatttcacagagactagaaaataagaatggaaggcttttagattaataaaagctccatgaaagccaggattttggaaatgctgtttctacaagttactagctggatgagttcacttctctatgcctcaattttctcatgtgtaagatgagaaaattaatagtacctgtgtcatagaggtgttgtgttggaggattaaatgaatttatgtatgaaactcttaagccagagcctggcacatagtaagcactcaataagtggtagctgttactttctcatttacccccatttccttagtttttagaatagtgtctgcaagatagtaggtacttaagtgataaatggatgtagaaattctgattgtaactactatattgttctacctacaccctgtatataaaagggataacttagtaatttttccccagtattttaaagaaaaagtccttattcccaacattatgtctttccagatatgttgaggtcatgatgtataatggaaattaaagcaaagggaatacttttttaaatactttattgaactttataggtaagaaatgttgtctttaggaaatgacatttggagataatttactgaagcatctcttagatcattgggttattagtaaagacgaaaacagaagttaggattttgtgccagtgtatttatatcatatttggaagacattcaaactgtaactcttctaatggtctacgtacattttatttcactgtaagtgtaacataaaacaaaggtaaaatttcttgctaacgcttaccaacatctacttctagagacctggcctgagttttttaagaaaaatttttgtcctcaggaaagatgcatacactgtaagtagtgtattcagttatcaaaattcttgtggcattggccatttggtttgttaccgttactctatttttatttatctgagtaaaaggaattgattattctttaaaatgaaagggattgttttttaatgttctaggatacacattttacctctataaaaatgctgaataactttttagaaaaacttacaattaagtatacatcttaaaaattcatatgcttaaaggatggaagtgtagtctatagtagagtcttcaaacaagggtctacatactcctgggaatattaaactttctaagggatatgcaggcataaatagctttaagggaatgcaaattcagatcgcagtgcccatgtaaatcctttattaaaattgacctacataaaaacatatccatatcaagggatcatgccagttctttttccctgctgccttttggtaatcactggtctcccattttacaaaagaaacctatggcaagttgtgttttgcagaaatgaccccaacaatatttaaagtctcatacccttctcgaaccttgccactacccttatcaagatgtggagttacgtcccttccctttgaacattaacagactttttttttttttcaaagagttagagggtctccttataggggcctccctgtattacccaggctggtctctaactcttaggcttaaggggtcctccagcctcggcctcccaaagtgctggaattacaggtgtgagccaccacgcttggccccttagccaacttctgactgccataattaagagaatatgatggaagttaatctattttcattgtgggtaaagtgtggtgttaaaaatgagttataggccaggcactatggctcacacctgtaatcccagcactttgggagcccaggtgggcagatcacttgaggttcggagtttgagaccagcctggccaatatggtaaagcctcgtctccactaaaaacacaaaaataagctgggcatggtggcgcgcgcctgtaataccagctactggggaggctgaggcagaagaatcacttgaacccaggaggcagaggttgcagtgagccgagatagtgccactgcactccagcctgggtgacagagtgatactccatctcaaaaaaaaaaaaaaataagttatattggcccgtgtggagatgttcagaattcagatgtattatcaagttgggaaataatgatgaaagtgttcagtgaccttgcctttttgtttctggactattcaaaaaatcatttcctttgtgggtacattgtgtgaaaggaaagcaaagagcatgagtttaacatgaaggaaaagataccttatttttaggcaaaaagcaaatggtgaggctctttgcctcatctacctaagaattaaaatattcaagattagtaaaaaagcatgattagttttggtgaatctcctgtgaagcaaactctgtatttccaccattcttttttttttttttttttttttgagacgaagtcttgttctgtcacccatgctggagtgcagtggcacgatctcagctcactacaacctctgcctcccaagttcaagcaattctcctgcctcagcctcccgagtagttgggactacaggcatgtgccaccacacccagctaattttttgtatttttagtagaggcagggtttcaccctgttagccaggatggtctcaatctcctgacctcatgatctgcccagcctcagcctcccaaagtgctgggattacaggcgtgagccaccgcgcccggccctccaccattcttgataattataaagagcctgatgaagatatctcaattcctgtctcagtagcatagtttgcatgatatcaaggaggaggaagttaaaagtttcatgtttacttctgacatactaacattacatcttcaagttaaaaacattttagaagtaagttcatgaatttatattttctgaaacattttcagattcttaagagaaacattttcattaacccttgccagtacatttattattaggttctataaattccatattaattgttttacataggccaaagtctcctgctattgtcactcaaccatttctctgtatcattcattcctaccatatacttaggtttaagttaacagaaatatgttgtagtttttactgtaaataagacacataatcgcctggttggaaggtagtgagttatcttaattgattgttcagtcagttacagatcgaactctttgttctcgtcttccccccgcttctcactgctgcacttgactagtctgaaaaaaaaaaatacatagtagtcatcagtacacctgatataagccctgaacttcctaatgacctctttttttgtgtgtgtgtgacagagtcttactgtgttgcccaggctggagtgcagtggtgtgatctcggctcactgcaacctccgcctcctgggttcaagcagttctcctgccttagcctcctgagtagatgggattacaggtgcaagccaccatgcctggctaatttttatatttttagtagagatggagtttcgccatgttggccaggctggttttgaacagctgacctcaggtgatccacccacctcagcctcccaaagtgctgggcttacatgggtgaggcagtgcacccagcctgaattacctcttttattttgctcataatttccataatttatcatctaatttaagatgctttgagattcactattattttatatgccacttagtaaaaatactgccagttaagctgtgacatgtcattgattataagatacatcttaatttcagagatgttaaatacatgtcttagtttgataaaataccatacaatacttttcttttttttgagaccgatcctgctatgttgcccaggctggtctccaactcctgcctcagcctcccaagtagctgggattacaggtgtgtgacactacacccagctcacatacaatactgttttttgtttgtttgtttgttttttgagacagagtcttgccctgtcgcccaggctgcagtgcagtggcgtgatctcgcctcactgcaacctccacctcccgggttcaagcaattcttctgcctcagcctcccaagtaactgggacaacaggcacgcaccaccacaccctgctaattttttatatttggtagagatggggtttcaccatattggcaaggctggtctcgaactcctgacctcgtgatctgcccacctcggcctcccaaagtgctgagattacaggcctaagccaccgttcctggcctatagtactcttaaaagcagaacatatacttagatataagtaggtatatagaagtaaatgtctccaaaaggtagtgtaggacaatacatttgaaaattggctttaacccatcctggctaacacagtgaaaccccgtctctactaaaaataaaaaaaaaaaaatagccaggcatggtggcgggcgcctgtagtcccagctagtcgggaggctgaggcaggagaatggcatgaacccgggaggcagaggttgcagtgagttaagatggcgccactgcactccagcctgggcgacagagcgagactctgtctcaaaataaaaaaaaaaaaaagaaaatcggctttatttaattagggttaactcttctcagatacttgtatttgttcaaattcattaaaaaccataattgaggctgggcgcggtggctcacgcctgtaatcccagcactttgggaggccgaggcgggcagatcatgaggtcaggagttcgagaccagcctgcccaacatggtgaaaccccgtctctactaaaaatacaaaaattagacatggtggcatgtgcctgtatcccagctacttgggaggctgaggcaggagaattgcttgagcccaggaagtgaaggttgcagtgagccaagatctcaccactgcactccagcctgggcaacacagggagatcctgtctcaaaaaagaaaaaaatttttacagttgaaagattgccaacaatctaaatgaccataggagaaaggataaataagttgcatatttgcacagtataacaagatagttgattaaattagagccatttgatacaacatgaataaatctaaaattgtgtacaaacaaaagccaaagcaaaacttatgtgatattctttacgtcaaatttaaaagtctgcaaaacaatatgctgtactctctataaatggtaaatataaggtcatagtgtaaatacaaatgaaggtaacatgctttagatatagtaattattttggggtgggttcagggagatacaagcttcagatggacatggatgtgtgagtggatatgtatttcaagtcaaccaaatttggaaaatgttaaaatttattaaacctcaccatggaatacacgta

SEQ ID NO: 155439 - DNA, 1950 bp, Homo sapiens
  Payload ID: 10559
  Gene Symbol: MPL
  Gene Name: MPL proto-oncogene, thrombopoietin receptor
  Uniprot ID: P40238
  ENST ID: ENST00000372470
  CDS Start-End: 43-1950
gaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttga

SEQ ID NO: 155440 - DNA, 1743 bp, Homo sapiens
  Payload ID: 10559
  Gene Symbol: MPL
  Gene Name: MPL proto-oncogene, thrombopoietin receptor
  ENST ID: ENST00000413998
  CDS Start-End: 1-1650
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggtaccgcccccgccaggcaggagactggcggtggaccaggtggagccgaaggcctgtaaacaggcattcttggttcgctctgtgaccccagatctccgtccaccgcccgtgcgcacctacggcttcgccacttcctgcacgtcacctctgggactcgccgcggctccttacactctaa

SEQ ID NO: 155441 - DNA, 1740 bp, Homo sapiens
  Payload ID: 10559
  Gene Symbol: MPL
  Gene Name: MPL proto-oncogene, thrombopoietin receptor
  ENST ID: ENST00000612993
  CDS Start-End: 1-1740
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggtaccgcccccgccaggcaggagactggcggtggaccaggtggagccgaaggtgtaaacaggcattcttggttcgctctgtgaccccagatctccgtccaccgcccgtgcgcacctacggcttcgcccttcctgcacgtcacctctgggactcgccgcggctccttacactctaa

SEQ ID NO: 155442 - DNA, 1567 bp, Homo sapiens
  Payload ID: 10560
  Gene Symbol: MPND
  Gene Name: MPN domain containing
  Uniprot ID: Q8N594
  ENST ID: ENST00000262966
  CDS Start-End: 68-1483
cggggcggggccgcgtgacgtgccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagcca

SEQ ID NO: 155443 - DNA, 1475 bp, Homo sapiens
  Payload ID: 10560
  Gene Symbol: MPND
  Gene Name: MPN domain containing
  Uniprot ID: Q8N594
  ENST ID: ENST00000359935
  CDS Start-End: 41-1396
aagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctgatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagcc

SEQ ID NO: 155444 - DNA, 407 bp, Homo sapiens
  Payload ID: 10560
  Gene Symbol: MPND
  Gene Name: MPN domain containing
  ENST ID: ENST00000594162
  CDS Start-End: 1-330
gacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcag

SEQ ID NO: 155445 - DNA, 379 bp, Homo sapiens
  Payload ID: 10560
  Gene Symbol: MPND
  Gene Name: MPN domain containing
  ENST ID: ENST00000601877
  CDS Start-End: 1-366
agaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggtgtgtggcccaccctgtctaggggcaaggggctccggagcccagtcggtgggcagcgggcggggctcccctgcgtatcagctccatgagagctggggccttgtctgctttgtttgctactggtacactgtgggtgctcaataaatgtatgaaggag

SEQ ID NO: 155446 - DNA, 1547 bp, Homo sapiens
  Payload ID: 10560
  Gene Symbol: MPND
  Gene Name: MPN domain containing
  ENST ID: ENST00000594716
  CDS Start-End: 29-1288
agagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgaggtgccgatcccggtgcagagctgagccggggtgtgcactctcccgttcccagcccgggcactgccaattgtccccagctgccatgggctgcgggctggtgaggcttctctcactggtctgtgtccctgccagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctgga

SEQ ID NO: 155447 - DNA, 1445 bp, Homo sapiens
  Payload ID: 10560
  Gene Symbol: MPND
  Gene Name: MPN domain containing
  ENST ID: ENST00000597036
  CDS Start-End: 1-1409
cggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgag

SEQ ID NO: 155448 - DNA, 1578 bp, Homo sapiens
  Payload ID: 10560
  Gene Symbol: MPND
  Gene Name: MPN domain containing
  ENST ID: ENST00000596722
  CDS Start-End: 1-1512
ggcgggcccagcggggcggaggcgcggggcgcggggctgcaggggcgcggggctgcagagccgtggggcgagcggcctccctgcagcctctcgctgtccgcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaac

SEQ ID NO: 155449 - DNA, 1611 bp, Homo sapiens
  Payload ID: 10560
  Gene Symbol: MPND
  Gene Name: MPN domain containing
  ENST ID: ENST00000599840
  CDS Start-End: 36-1541
ggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaa

SEQ ID NO: 155450 - DNA, 998 bp, Homo sapiens
  Payload ID: 10561
  Gene Symbol: MPV17
  Gene Name: MpV17 mitochondrial inner membrane protein
  Uniprot ID: P39210
  ENST ID: ENST00000233545
  CDS Start-End: 48-578
gagggacggtgggggtgaccccctctcctcttggcttgacaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaa

SEQ ID NO: 155451 - DNA, 2011 bp, Homo sapiens
  Payload ID: 10561
  Gene Symbol: MPV17
  Gene Name: MpV17 mitochondrial inner membrane protein
  ENST ID: ENST00000357186
  CDS Start-End: 1231-1593
acagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgctttttggagagagtggagatgagatcagtgcctacctggaacaaaaccctctggcattctagactggctgaatatgtagtgtagggactttatcatctgtcagaaaatctcctttaagaagaagcgatcaagaagtttagtcctggccaggtgtggtggctcacgcctgtaatcccaacactttgggaggccaaggcaggcggattacttgaggtcagaagttcaagaccagcctggccaatgtatggtgaaaccccgtctctaccaaaaatgtaaaaaattagccaggtgtgatggcacacacctgcaatcccagctactcaggaggctgaggcagaagaatcatttgaacctgggatgcagaggttgcagtgagccgagatcctgccactgcactccagcctgggtgacggagcgagactccgtctcaaaaagagttcagcccctatcctgtacagatgagaaaatagacctggaggaaacccaagtctatcaacagcagagaccacaacccatgtcagtgcaaagaagccaagtgttgcactaccctattgggatccagctcacattgagccagttttgttttttgagctgttacgcaagtgccttctgtcgaagagaagctttactcaattctacagggcagcccccttcctattttcagtggtagaaaagatgagacctggggatccacacttgaggctgtagattggtgctggcagccctgcttctgcaactgagtctcagccctagtcttgaccttgttctttttctctaacaagccttttctctttctaaccctccctcccaatatacccacttcatactatccattgttcatacacttctctacctttattcctcttctcatattcctcccttcgccagagtgtctttttccaccatcttcacctgagttcaattcatccttcaaggtcccggctcaaattccaccttcaccaaagagcttcccagttttctccagtaaaaaatagtttccctcccttgtgttcccaagggggaagggaggaaaaaggataaacaagcattaagcacttgatccattttaggcacttcgcatgtgtcacttgtatgagggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgg

SEQ ID NO: 155452 - DNA, 1005 bp, Homo sapiens
  Payload ID: 10561
  Gene Symbol: MPV17
  Gene Name: MpV17 mitochondrial inner membrane protein
  Uniprot ID: P39210
  ENST ID: ENST00000380044
  CDS Start-End: 57-587
gcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgg

SEQ ID NO: 155453 - DNA, 749 bp, Homo sapiens
  Payload ID: 10561
  Gene Symbol: MPV17
  Gene Name: MpV17 mitochondrial inner membrane protein
  ENST ID: ENST00000399052
  CDS Start-End: 52-384
agttcctaggccagcctgtcacgtgggagggaggctcggcgctcaggaagcatggcactctggcgggcataccagcgggccctggccgctcacccgtggaaagtacaggtcctgacagctgacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaagaatattgctgtctgccatccccacgaggtgacaaggagcagaatgatggaatttgggggagtaaagacagagaggaagtgcattagtctagggaatgtcctttgatatgcaggccctttggggcctcacttgggcaggaacacccagcaggggagcagccacaggggcctcctggtgccactgacctctgagcccatctcagcccatgccaggaataccctggcctccttggtcctccttgagagaaggcctgggttcagttccaactgcactccttaccaagtcatctcatctctcaaagactcatcattaaatgggggtgtaggctgggtgccgtggctcacacctataatcccaacactttgggcggccaaggcaggtggatcacctggggtcaggagtttgagaccagcctggctaacatggtgaaaccccatctctactaaaaatacaaaaatcagccaggtgtg

SEQ ID NO: 155454 - DNA, 906 bp, Homo sapiens
  Payload ID: 10561
  Gene Symbol: MPV17
  Gene Name: MpV17 mitochondrial inner membrane protein
  ENST ID: ENST00000402310
  CDS Start-End: 9-521
caggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatgttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaa

SEQ ID NO: 155455 - DNA, 859 bp, Homo sapiens
  Payload ID: 10561
  Gene Symbol: MPV17
  Gene Name: MpV17 mitochondrial inner membrane protein
  ENST ID: ENST00000405983
  CDS Start-End: 18-593
ctcggcgctcaggaagcatggcactctggcgggcataccagcgggccctggccgctcacccgtggaaagtacaggtcctgacagctgcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacc

SEQ ID NO: 155456 - DNA, 603 bp, Homo sapiens
  Payload ID: 10561
  Gene Symbol: MPV17
  Gene Name: MpV17 mitochondrial inner membrane protein
  ENST ID: ENST00000405076
  CDS Start-End: 57-398
gcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattccca

SEQ ID NO: 155457 - DNA, 665 bp, Homo sapiens
  Payload ID: 10561
  Gene Symbol: MPV17
  Gene Name: MpV17 mitochondrial inner membrane protein
  ENST ID: ENST00000403262
  CDS Start-End: 22-537
gaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacagggaggatcctgcttctaccacccttgtctccatcccacctgagctccgtctttgatggcatatctggagggacagtggctggggtgctgcagcctaggttagacagagaggtagaccagaaggccaagtaggagcctggtcagacactcacaataaagacagttgctgaactgcacccaaaaa

SEQ ID NO: 155458 - DNA, 827 bp, Homo sapiens
  Payload ID: 10561
  Gene Symbol: MPV17
  Gene Name: MpV17 mitochondrial inner membrane protein
  ENST ID: ENST00000402722
  CDS Start-End: 36-335
tgtcacgtgggagggaggctcggcgctcaggaagcatggcactctggcgggcataccagcgggccctggccgctcacccgtggaaagtacaggtcctgacagctgcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatgg

SEQ ID NO: 155459 - DNA, 597 bp, Homo sapiens
  Payload ID: 10561
  Gene Symbol: MPV17
  Gene Name: MpV17 mitochondrial inner membrane protein
  ENST ID: ENST00000415514
  CDS Start-End: 18-257
ctcggcgctcaggaagcatggcactctggcgggcataccagcgggccctggccgctcacccgtggaaagtacaggtcctgacagctgacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaaggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcct

SEQ ID NO: 155460 - DNA, 905 bp, Homo sapiens
  Payload ID: 10561
  Gene Symbol: MPV17
  Gene Name: MpV17 mitochondrial inner membrane protein
  ENST ID: ENST00000426513
  CDS Start-End: 38-337
cctgtcacgtgggagggaggctcggcgctcaggaagcatggcactctggcgggcataccagcgggccctggccgctcacccgtggaaagtacaggtcctgacagctgcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaacc

SEQ ID NO: 155461 - DNA, 575 bp, Homo sapiens
  Payload ID: 10561
  Gene Symbol: MPV17
  Gene Name: MpV17 mitochondrial inner membrane protein
  ENST ID: ENST00000428910
  CDS Start-End: 229-575
ggagggaggctcggcgctcaggaagcatggcactctggcgggcataccagcgggccctggccgctcacccgtggaaagtacaggtcctgacagctggcctcctggactgaaggacacgcttcctgctcctcactccaagaagccacttcttgcccctctgccttctgcgcatgaaactcaaaagccacaaaagaatattgctgtctgccatccccacgagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgca

SEQ ID NO: 155462 - DNA, 482 bp, Homo sapiens
  Payload ID: 10561
  Gene Symbol: MPV17
  Gene Name: MpV17 mitochondrial inner membrane protein
  ENST ID: ENST00000430991
  CDS Start-End: 1-365
ggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagc

SEQ ID NO: 155463 - DNA, 5820 bp, Homo sapiens
  Payload ID: 10562
  Gene Symbol: MPV17L
  Gene Name: MPV17 mitochondrial membrane protein-like
  Uniprot ID: Q2QL34
  ENST ID: ENST00000287594
  CDS Start-End: 145-588
aatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcgagtggactgatgtactggccctttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcctgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggagcttgcagtgagcagagatcaggccactgcactccagcctaggcgacagagcgagaatctgtctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttatgtctataatccaagtgctttgggaggcgaaggcaggtggatcatctgagcccaggagtttgagaccagcctaggcaacatggcaagagcctgtctctccaaaacctacaaaaattagccaagcatggtggtgtgagcctgtagtcccagctacttggaagactcatgcaggaggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatcccagcactttgggaggccaaggcaggtggatcggttgaggtcaggagttcaagaccagcatggccaacacagtgaaaccccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattcacaatttatcagtcttttttgtttgtacaaaaactaatataagttattctcttttatttgtattgtgattggtttgatgagagggaattaggccacttgagagtttgtgcgtgtttataattttctggctgggcccggtggctcatgcctgtaatcccagcactttgggaggccaaggcgggcggatcacttgagctcaggagtttgagaccaacttgggcaatgtggtgaaaccctatccctaccaaaaatacaaaaattagccgggtgtggtggcttgcacctgtcctcccagctacttgggggtgctgaggcaggaggatcactcaagcccaggaggtggaggttgcagtgagccgagatcacgccactgcactccaggaagggcaacagagcaagactgtgtctataaaaaaaaaaaaaaagaaagaaaagtaaattaactttggtatttcaggttgtatttatatggggacttcacatcaactatgttcactacaattgaccaagttaagtgtagacagtctctttaatagagagattatctggaactgcaattttttttttttttttgagacagagtttcgctttgtagcccaggttggagtgcagtgtcgcgatctcgcctcactgcaacctctgtctcccgggttcacgccattctcctgcctcagcccaagtagcagggactaaaggcgcccgccaccatgacccactaattttttttttttttggatttttagtagagtcggggtttcactgtgttagccaggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggaaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaa

SEQ ID NO: 155464 - DNA, 1037 bp, Homo sapiens
  Payload ID: 10562
  Gene Symbol: MPV17L
  Gene Name: MPV17 mitochondrial membrane protein-like
  Uniprot ID: Q2QL34
  ENST ID: ENST00000396385
  CDS Start-End: 120-710
gcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtatgagcattctccaaggaaaggatgacatatttttggacctgaaacagaaattctggaatacctatctgagtggactgatgtactggccctttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaa

SEQ ID NO: 155465 - DNA, 529 bp, Homo sapiens
  Payload ID: 10562
  Gene Symbol: MPV17L
  Gene Name: MPV17 mitochondrial membrane protein-like
  ENST ID: ENST00000564148
  CDS Start-End: 1-159
aactacgtgtggctgcgcctgctggagcgcgcgctcccgggccgagcgccgcacgccctgctggccaagttgctgtgcgaccaggtggtcggtgcgcccatcgcggtctcggccttctatgtcgggtctcactctattccccaggctgaagtgcagtgatgtgatcacagctcattgcagcctcgacctcctgggctcaagcgatcctcccacctctgcctctggagtagctgggactacaggtatgagcattctccaaggaaaggatgacatatttttggacctgaaacagaaattctggaatacctatctgagtggactgatgtactggccctttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtc

SEQ ID NO: 155466 - DNA, 5822 bp, Homo sapiens
  Payload ID: 10562
  Gene Symbol: MPV17L
  Gene Name: MPV17 mitochondrial membrane protein-like
  Uniprot ID: Q2QL34
  ENST ID: ENST00000612041
  CDS Start-End: 145-588
aatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcgagtggactgatgtactggccctttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaataccttttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgactttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcccgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacgctttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggagcttgcagtgagcagagatcaggccactgcactccagcctaggcgacagagcgagaatctgtctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttatgtctataatccaagtgctttgggaggcgaaggcaggtggatcatctgagcccaggagtttgagaccagcctaggcaacatggcaagagcctgtctctccaaaacctacaaaaattagccaagcatggtggtgtgagcctgtagtcccagctacttggaagactcatgcaggaggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatcccagcactttgggaggccaaggcaggtggatcggttgaggtcaggagttcaagaccagcatggccaacacagtgaaaccccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattcacaatttatcagtcttttttgtttgtacaaaaactaatataagttattctcttttatttgtattgtgattggtttgatgagagggaattaggccacttgagagtttgtgcgtgtttataattttctggctgggcccggtggctcatgcctgtaatcccagcactttgggaggccaaggcgggcggatcacttgagctcaggagtttgagaccaacttgggcaatgtggtgaaaccctatccctaccaaaaatacaaaaattagccgggtgtggtggcttgcacctgtcctcccagctacttgggggtgctgaggcaggaggatcactcaagcccaggaggtggaggttgcagtgagccgagatcacgccactgcactccaggaagggcaacagagcaagactgtgtctataaaaaaaaaaaaaagaaagaaaagtaaattaactttggtatttcaggttgtatttatatggggacttcacatcaactatgttcactacaattgaccaagttaagtgtagacagtctctttaatagagagattatctggaactgcaattttttttttttttttgagacagagtttcgctttgtagcccaggttggagtgcagtgtcgcgatctcgcctcactgcaacctctgtctcccgggttcacgccattctcctgcctcagcccaagtagcagggactaaaggcgcccgccaccatgacccactaatttttttttttttttggatttttagtagagtcggggtttcactgtgttagccaggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggcaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaa

SEQ ID NO: 155467 - DNA, 1037 bp, Homo sapiens; identical to SEQ ID NO: 155464
  Payload ID: 10562
  Gene Symbol: MPV17L
  Gene Name: MPV17 mitochondrial membrane protein-like
  Uniprot ID: Q2QL34
  ENST ID: ENST00000617552
  CDS Start-End: 120-710

SEQ ID NO: 155468 - DNA, 529 bp, Homo sapiens; identical to SEQ ID NO: 155465
  Payload ID: 10562
  Gene Symbol: MPV17L
  Gene Name: MPV17 mitochondrial membrane protein-like
  ENST ID: ENST00000633750
  CDS Start-End: 1-159

SEQ ID NO: 155469 - DNA, 1408 bp, Homo sapiens
  Payload ID: 10563
  Gene Symbol: MPV17L2
  Gene Name: MPV17 mitochondrial membrane protein-like 2
  Uniprot ID: Q567V2
  ENST ID: ENST00000599612
  CDS Start-End: 101-721
gggagccggaggggcgggcaatttgggatcgacagtgactcgcgactggtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggccttggctgcctggagggtcagacagtgggtgagagctgccaggagctgcgggagaagttctgggaattctacaaggcagactggtgcgtgtggcctgctgcgcagttcgtgaacttcctcttcgtgcccccccaatttcgagtcacctacatcaacggcctgacgctgggctgggacacgtacctgtcctacttgaagtaccggagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaa

SEQ ID NO: 155470 - DNA, 6897 bp, Homo sapiens
  Payload ID: 10564
  Gene Symbol: MRE11A
  Gene Name: MRE11 homolog A, double strand break repair nuclease
  Uniprot ID: P49959
  ENST ID: ENST00000323929
  CDS Start-End: 224-2350
agccaatgagagccgaactggacttgaagcatctacgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaagccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttagaaaaaaactgagtaaaaaagtatctcaatgggctgggtgcagtggctcatgcctttaatcccagcactttgggaggccgaggagggggttcacctgaggtcaggagtttgagaccagcctggccaacatggtgaaacctcgtctctactaaaaatacaaaagattagctgggcatggtggtgtgtgcctgtaatcttagctactcaggaggctgaggcaggagaatcgcttgaacccaggaggcagaggttgcagtgagccgagattgtgccattgcactgcagcctgggcaacaagagtgaaactcaatctcaaaaaaaaaaaaagtatctaaatgtaaaatatcttttttggaaatatagaatttaaaagcgactttcccccaaagaaatctgatgtcctttttgtatctgtcataaatttaattcatagtattttgggttttttttgttttttttttttgagacggagtctcgcactcttgcccaggctggagggcaggggcaccatttcggctcactgcaagctccacgccattctcctgcctcagcctcccaagtagctgggactacaggcgcccaccaccacgcctggctaatttttttttttttttttttgtatttttagtagagacagggtttttctgtgttagccaggatggtctcgatctcctgaccttgtgatccacccacctcagcctcccaaagtgctgggattacaggcctgagccaccacgcccagcctattttgtgtttttttaaagctaactaccattaagatcattatagaagtttggtataatgaagatttgggtttttcagtccaatgagtttccatattcttgaatgaaaaagatccacatttcatcatttgcctgtttcattttcttttagtacttttgaacttagtttggtcagaaaatactagaattttagtttgatctaaagaaccagcttatataacttgctgttgccatgtacatttgtatgtctttgctgtgtcaaataactggatctgattttagctctttttaagtggtgaaagcaatgcatttttattcttcaaattcagacattgaatgtgtattaaaatgtgtgtgcttacctttaatcctctccccaccgacaattaggaacacgtttctccaattactgttggcaagactaccaagaaaaattgttgaattagaatcccagcaccgggcacggtggctcacgcctgtgatcctagcactttgggaggccaaagcaggcggatcacctgaggtcaggagttcgagaccagcagggccaacatggcgaaaccccgactctactaaaaatacaaaaattagccaggcatggtggtgggcgcctgtaatcccaactactcaggaggctgaggcaggagaattgcttgaacctgggagttggaggtcacggtgagctgatatcacgccattgcactccagcctgggcaacagagcaagactctgtctcaatcaatctatccatcaatcgataagaaccccagattgtatagctacatgttttagcccccttttcaaagtatatgttctccttggtacttattttgacattctgacttttctacatatgctttatcaacctcttaattaaaccatcattgtctattttgagagataactgcgctgcttcccgttgtgtgttttaaatgttattgttcagtttgagtcaaataaaaggatatttaatctgtggtgccttga

SEQ ID NO: 155471 - DNA, 2588 bp, Homo sapiens
  Payload ID: 10564
  Gene Symbol: MRE11A
  Gene Name: MRE11 homolog A, double strand break repair nuclease
  Uniprot ID: P49959
  ENST ID: ENST00000323977
  CDS Start-End: 297-2339
acgttatccatgaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtgggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttcta

SEQ ID NO: 155472 - DNA, 2604 bp, Homo sapiens
  Payload ID: 10564
  Gene Symbol: MRE11A
  Gene Name: MRE11 homolog A, double strand break repair nuclease
  ENST ID: ENST00000393241
  CDS Start-End: 234-2357
aaacggacgccgttctctcccgcggaattcaggtttacggccctgcgggttctcagaggcaagttcagaccgtgttgttttcttttcacggatcctgccctttcttcccgaaaagaagacagccttggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttc

SEQ ID NO: 155473 - DNA, 2684 bp, Homo sapiens
  Payload ID: 10564
  Gene Symbol: MRE11A
  Gene Name: MRE11 homolog A, double strand break repair nuclease
  Uniprot ID: P49959
  ENST ID: ENST00000407439
  CDS Start-End: 290-2425
gacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaaggtgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatg

SEQ ID NO: 155474 - DNA, 572 bp, Homo sapiens
  Payload ID: 10564
  Gene Symbol: MRE11A
  Gene Name: MRE11 homolog A, double strand break repair nuclease
  ENST ID: ENST00000536754
  CDS Start-End: 192-572
ttgaagcatctacgttatccatgaagtgtcgcgagagaaacggacgccgttctctcccgcggaattcaggtttacggccctgcgggttctcagagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggc

SEQ ID NO: 155475 - DNA, 1212 bp, Homo sapiens
  Payload ID: 10564
  Gene Symbol: MRE11A
  Gene Name: MRE11 homolog A, double strand break repair nuclease
  ENST ID: ENST00000540013
  CDS Start-End: 150-815
ctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgtta

SEQ ID NO: 155476 - DNA, 558 bp, Homo sapiens
  Payload ID: 10564
  Gene Symbol: MRE11A
  Gene Name: MRE11 homolog A, double strand break repair nuclease
  ENST ID: ENST00000538923
  CDS Start-End: 226-558
acggccctgcgggttctcagaggcaagttcagaccgtgttgttttcttttcacggatcctgccctttcttcccgaaaagaagacagccttgggtcgcgattgtggggcttcgaagagtccagcagtgggaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactat

SEQ ID NO: 155477 - DNA, 2781 bp, Homo sapiens
  Payload ID: 10565
  Gene Symbol: MRGBP
  Gene Name: MRG/MORF4L binding protein
  Uniprot ID: Q9NV56
  ENST ID: ENST00000370487
  CDS Start-End: 72-686
agtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacattggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacatccctggccatctgtccctgaagtcctcctcaccatgacgcagatcacaaggcacccactaaaggggcaaagccaggaatcccgtgccatgtgatcgccccgtgtggcacctgccactcgtctgcaccaaacgcactgccagttctggggaagaacagcccagggaagctgctggtctacggcctgcctgagctgtattccaagggtagagcagctgcctggggggaccctgtgggtcccttttctatagagccgggacaaatccacagccctgcagtaacagcctgccacaaagagcaggcatctggagggccccacacacatagaccaaaggactgagcccgcctggcattcctccactcacagcacaaatactcagccctgcagccagggaagggtggggtctccctttgctgcccaagtgtgcccccttgcccgtctgatctctcctgttaggtcagcctcattcagggctttgtgccaggtcctgtcctggagtctcagtccgggacagcagcctggctcttaggcagtccagaagcagcagggcaaaggggggcaaatactaacacggggtgtcacgggatggccaggaggagtcctgctcgccacccaggctcactgtcctaaacctccatctgaaaccgcatctcgggtgacctcagattgtgctaggaaagcctagttaataaatctgcctcatctcgattactgtaa

SEQ ID NO: 155478 - DNA, 6090 bp, Homo sapiens
  Payload ID: 10566
  Gene Symbol: MROH7-TTC4
  Gene Name: MROH7-TTC4 readthrough (NMD candidate)
  ENST ID: ENST00000425300
  CDS Start-End: 397-2355
aggggcagctctgggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaagtgcggagcttgttaacagacgtgcatgcctggcctgtggactgtgcagtaagtgttgaaaaaggcactcttccctgacttgatttctttctgcatctcctcccaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgaggatggagtttcactcttgttgcccaggctggagtgcaatggtgcgatctcggctcactgcaacctctgcctcccaggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagcaactcctagagggcagagatttcatctgctctgcccaccgctatatagccagccactagaacaggccggaagcgcagaaagagctaagaatttgaaaaggtccccctatttatgtcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactcagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctga

SEQ ID NO: 155479 - DNA, 5867 bp, Homo sapiens
  Payload ID: 10566
  Gene Symbol: MROH7-TTC4
  Gene Name: MROH7-TTC4 readthrough (NMD candidate)
  ENST ID: ENST00000414150
  CDS Start-End: 279-4283
ggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgcaactcctagagggcagagatttcatctgctctgcccaccgctatatagccagccactagaacaggccggaagcgcagaaagagctaagaatttgaaaaggtccccctatttatgtcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactcagatccttggtacccctaaaaagattgccaattttcttcatctttgccatatggaggactgtgacagactttggacagtggcctcttgagttcctctgcagttttgacatttaggattttgtgtcttttaaactggaaaatcttctagca

SEQ ID NO: 155480 - DNA, 5162 bp, Homo sapiens
  Payload ID: 10566
  Gene Symbol: MROH7-TTC4
  Gene Name: MROH7-TTC4 readthrough (NMD candidate)
  ENST ID: ENST00000606515
  CDS Start-End: 293-2176
gaggggcagctctgggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgcaactcctagagggcagagatttcatctgctctgcccaccgctatatagccagccactagaacaggccggaagcgcagaaagagctaagaatttgaaaaggtccccctatttatgtcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtct

SEQ ID NO: 155481 - DNA, 3821 bp, Homo sapiens
  Payload ID: 10567
  Gene Symbol: MRS2
  Gene Name: MRS2 magnesium transporter
  ENST ID: ENST00000274747
  CDS Start-End: 140-1321
cgcggcacgccccgcgcatgcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctgcagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgccaaaaatatatgaagttccttggttttaaattttgaactaaaatggactgagcacattaattactgtttgaaagtaggtaccaaacactgggttatgtgagtgagtaagcaatcatatcgcctgtcaaacacatcaagtgtcgaacacgtcaaggtgtgatactgtctttggaaggctcctaaacaaatgtgagcacaattattaacaccttattcttcatgaacacagactgttaagcagcactaaccaattttatattaaaaagctatttattttggtgagttattccaagagttgtatacagctttattttttggaattgcaatattaaagttgcacgttggatttaactctcatgactttagtaatacctacagaggtgagctaatggatggtacatggagtagggactgcagagaccctagttttgtccccactccatcttcaaataattttggtctcttaggtctgtgatacaaaggcataaaacaattcctatcttgaagccttgagaaaagctgttacatatacgcagatagtagcaagacagaaaatgcaaatatgtaaatgtcttctgatatcttgaaataaagataaatttcagttaaacttg

SEQ ID NO: 155482 - DNA, 1740 bp, Homo sapiens
  Payload ID: 10567
  Gene Symbol: MRS2
  Gene Name: MRS2 magnesium transporter
  Uniprot ID: Q9HD23
  ENST ID: ENST00000378353
  CDS Start-End: 94-1320
gcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatggtatgaaggatatggttcacggcggtattgtggaagggttatgatcatgggccctaaagtcagagcgcctgggattaagttgtcacaggcactatggcccttgcgagttgctttctcaaacttccttcagtttccctatctgtcagttaagtcggtattacctgcttcatagggttatgggaagaattaaacaatatgtgtaaagcacttactagcacactgcctaacacaataagttagaaatataatttgtgtagaactctgacaacatacatttaaacagatgttagtaattctggtataaggtttgtcataaccaaatggaaatgtaggaaacatttataacgttcttaaaagatagaaaattcacctccattttctttgtacttgaagatggcaccactggaataaatacttaagacactg

SEQ ID NO: 155483 - DNA, 3313 bp, Homo sapiens
  Payload ID: 10567
  Gene Symbol: MRS2
  Gene Name: MRS2 magnesium transporter
  Uniprot ID: Q9HD23
  ENST ID: ENST00000378386
  CDS Start-End: 94-1425
gcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctgcagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcca

SEQ ID NO: 155484 - DNA, 546 bp, Homo sapiens
  Payload ID: 10567
  Gene Symbol: MRS2
  Gene Name: MRS2 magnesium transporter
  ENST ID: ENST00000446191
  CDS Start-End: 1-546
gccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttgg

SEQ ID NO: 155485 - DNA, 3980 bp, Homo sapiens
  Payload ID: 10567
  Gene Symbol: MRS2
  Gene Name: MRS2 magnesium transporter
  Uniprot ID: Q9HD23
  ENST ID: ENST00000443868
  CDS Start-End: 140-1480
cgcggcacgccccgcgcatgcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagaaatattctctactcttggaatcagtagctagcattcttcaaaacagtgtctctttcatggagagacagacagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctgcagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgccaaaaatatatgaagttccttggttttaaattttgaactaaaatggactgagcacattaattactgtttgaaagtaggtaccaaacactgggttatgtgagtgagtaagcaatcatatcgcctgtcaaacacatcaagtgtcgaacacgtcaaggtgtgatactgtctttggaaggctcctaaacaaatgtgagcacaattattaacaccttattcttcatgaacacagactgttaagcagcactaaccaattttatattaaaaagctatttattttggtgagttattccaagagttgtatacagctttattttttggaattgcaatattaaagttgcacgttggatttaactctcatgactttagtaatacctacagaggtgagctaatggatggtacatggagtagggactgcagagaccctagttttgtccccactccatcttcaaataattttggtctcttaggtctgtgatacaaaggcataaaacaattcctatcttgaagccttgagaaaagctgttacatatacgcagatagtagcaagacagaaaatgcaaatatgtaaatgtcttctgatatcttgaaataaagataaatttcagttaaacttg

SEQ ID NO: 155486 - DNA, 2315 bp, Homo sapiens
  Payload ID: 10568
  Gene Symbol: MRTO4
  Gene Name: MRT4 homolog, ribosome maturation factor
  Uniprot ID: Q9UKD2
  ENST ID: ENST00000330263
  CDS Start-End: 298-1017
tcccggcatgcaccgcgccgcgggctccgcctccgcgggaccacagagctgggatagcgcgcgaggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcgggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgta

SEQ ID NO: 155487 - DNA, 2069 bp, Homo sapiens
  Payload ID: 10569
  Gene Symbol: MSANTD3-TMEFF1
  Gene Name: MSANTD3-TMEFF1 readthrough
  ENST ID: ENST00000502978
  CDS Start-End: 8-1033
cgccagcatgctgccggagcagctctacttcctgcagagccccccggaggaggagcccgaataccaccccgacgcctcagcccaagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactata

SEQ ID NO: 155488 - DNA, 1939 bp, Homo sapiens
  Payload ID: 10570
  Gene Symbol: MSX1
  Gene Name: msh homeobox 1
  Uniprot ID: P28360
  ENST ID: ENST00000382723
  CDS Start-End: 235-1146
gggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcccggagcccatgcccggcggctggccagtgctgcggcagaagggggggcccggctctgcatggccccggctgctgacatgacttctttgccactcggtgtcaaagtggaggactccgccttcggcaagccggcggggggaggcgcgggccaggcccccagcgccgccgcggccacggcagccgccatgggcgcggacgaggagggggccaagcccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccaggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaa

SEQ ID NO: 155489 - DNA, 2241 bp, Homo sapiens
  Payload ID: 10571
  Gene Symbol: MSX2
  Gene Name: msh homeobox 2
  Uniprot ID: P35548
  ENST ID: ENST00000239243
  CDS Start-End: 128-931
cttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttctatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacaatgcacacagaaaatattagatatggagagattattcaaagtgaaggggacacatcatatttctgcattttacttgcattaaaagaaacctctttatatactacagttgttcctatctctcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaatatgctttctctgtgtgtgtacctgttgtatgtcctaaacttattagaaaattttatatacttttttacatgttggggggcagaaggtaaagccatgttttgacttggtgaaaatgggattgtcaaacagcccattaagttccctggtatttcaccttcctgtccatctgtcccctccctccggtatacctttatccctttgaaagggtgcttgtacaatttgatatattttattgaagagttatctcttattctgaattaaattaagcatttgttttattgcagtaaagtttgtccaaactca

SEQ ID NO: 155490 - DNA, 1188 bp, Homo sapiens
  Payload ID: 10571
  Gene Symbol: MSX2
  Gene Name: msh homeobox 2
  ENST ID: ENST00000507785
  CDS Start-End: 59-463
gccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagtgagtgcgcgccggggcaggagtaggaggacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttata

SEQ ID NO: 155491 - DNA, 3991 bp, Homo sapiens
  Payload ID: 10572
  Gene Symbol: MSH5-SAPCD1
  Gene Name: MSH5-SAPCD1 readthrough (NMD candidate)
  ENST ID: ENST00000493662
  CDS Start-End: 57-2612
ggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaa

SEQ ID NO: 155492 - DNA, 2216 bp, Homo sapiens
  Payload ID: 10572
  Gene Symbol: MSH5-SAPCD1
  Gene Name: MSH5-SAPCD1 readthrough (NMD candidate)
  ENST ID: ENST00000498473
  CDS Start-End: 1-793
gcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattgatgatacactgtcttttattctcttttaagaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaa

SEQ ID NO: 155493 - DNA, 950 bp, Homo sapiens
  Payload ID: 10572
  Gene Symbol: MSH5-SAPCD1
  Gene Name: MSH5-SAPCD1 readthrough (NMD candidate)
  ENST ID: ENST00000476085
  CDS Start-End: 1-88
tatgaaactggatttggaagatcctaacctggacttgaacgttttcatgagccaggaagtgctgcctgctgccaccagcatcctctgagagtccttccagtgtcctccccagcctcctgagactccgctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 155494 - DNA, 3992 bp, Homo sapiens
  Payload ID: 10572
  Gene Symbol: MSH5-SAPCD1
  Gene Name: MSH5-SAPCD1 readthrough (NMD candidate)
  ENST ID: ENST00000469644
  CDS Start-End: 57-2612
ggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 155495 - DNA, 2217 bp, Homo sapiens
  Payload ID: 10572
  Gene Symbol: MSH5-SAPCD1
  Gene Name: MSH5-SAPCD1 readthrough (NMD candidate)
  ENST ID: ENST00000482009
  CDS Start-End: 1-793
gcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattgatgatacactgtcttttattctcttttaagaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 155496 - DNA, 2121 bp, Homo sapiens
  Payload ID: 10572
  Gene Symbol: MSH5-SAPCD1
  Gene Name: MSH5-SAPCD1 readthrough (NMD candidate)
  ENST ID: ENST00000552302
  CDS Start-End: 1361-1807
gcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattgatgatacactgtcttttattctcttttaagaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctcc

SEQ ID NO: 155497 - DNA, 821 bp, Homo sapiens
  Payload ID: 10572
  Gene Symbol: MSH5-SAPCD1
  Gene Name: MSH5-SAPCD1 readthrough (NMD candidate)
  Uniprot ID: Q5SSQ6
  ENST ID: ENST00000547662
  CDS Start-End: 60-506
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctcc

SEQ ID NO: 155498 - DNA, 820 bp, Homo sapiens
  Payload ID: 10572
  Gene Symbol: MSH5-SAPCD1
  Gene Name: MSH5-SAPCD1 readthrough (NMD candidate)
  Uniprot ID: Q5SSQ6
  ENST ID: ENST00000548987
  CDS Start-End: 60-506
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctcc

SEQ ID NO: 155499 - DNA, 2121 bp, Homo sapiens; identical to SEQ ID NO: 155496
  Payload ID: 10572
  Gene Symbol: MSH5-SAPCD1
  Gene Name: MSH5-SAPCD1 readthrough (NMD candidate)
  ENST ID: ENST00000548003
  CDS Start-End: 1361-1807

SEQ ID NO: 155500 - DNA, 2217 bp, Homo sapiens; identical to SEQ ID NO: 155495
  Payload ID: 10572
  Gene Symbol: MSH5-SAPCD1
  Gene Name: MSH5-SAPCD1 readthrough (NMD candidate)
  ENST ID: ENST00000480622
  CDS Start-End: 1-793

SEQ ID NO: 155501 - DNA, 2218 bp, Homo sapiens
  Payload ID: 10572
  Gene Symbol: MSH5-SAPCD1
  Gene Name: MSH5-SAPCD1 readthrough (NMD candidate)
  ENST ID: ENST00000469011
  CDS Start-End: 1-793
gcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttggattggccaagggtttcaggacaggaaggaggtgattgatgatacactgtcttttattctcttttaagaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaat

SEQ ID NO: 155502 - DNA, 3993 bp, Homo sapiens
  Payload ID: 10572
  Gene Symbol: MSH5-SAPCD1
  Gene Name: MSH5-SAPCD1 readthrough (NMD candidate)
  ENST ID: ENST00000480850
  CDS Start-End: 57-2612
ggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaat

SEQ ID NO: 155503 - DNA, 2217 bp, Homo sapiens; identical to SEQ ID NO: 155495
  Payload ID: 10572
  Gene Symbol: MSH5-SAPCD1
  Gene Name: MSH5-SAPCD1 readthrough (NMD candidate)
  ENST ID: ENST00000492776
  CDS Start-End: 1-793

SEQ ID NO: 155504 - DNA, 3992 bp, Homo sapiens; identical to SEQ ID NO: 155494
  Payload ID: 10572
  Gene Symbol: MSH5-SAPCD1
  Gene Name: MSH5-SAPCD1 readthrough (NMD candidate)
  ENST ID: ENST00000583103
  CDS Start-End: 57-2612

SEQ ID NO: 155505 - DNA, 2871 bp, Homo sapiens
  Payload ID: 10572
  Gene Symbol: MSH5-SAPCD1
  Gene Name: MSH5-SAPCD1 readthrough (NMD candidate)
  ENST ID: ENST00000495073
  CDS Start-End: 1-1491
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 155506 - DNA, 950 bp, Homo sapiens; identical to SEQ ID NO: 155493
  Payload ID: 10572
  Gene Symbol: MSH5-SAPCD1
  Gene Name: MSH5-SAPCD1 readthrough (NMD candidate)
  ENST ID: ENST00000487383
  CDS Start-End: 1-88

SEQ ID NO: 155507 - DNA, 2871 bp, Homo sapiens; identical to SEQ ID NO: 155505
  Payload ID: 10572
  Gene Symbol: MSH5-SAPCD1
  Gene Name: MSH5-SAPCD1 readthrough (NMD candidate)
  ENST ID: ENST00000466318
  CDS Start-End: 1-1491

SEQ ID NO: 155508 - DNA, 950 bp, Homo sapiens; identical to SEQ ID NO: 155493
  Payload ID: 10572
  Gene Symbol: MSH5-SAPCD1
  Gene Name: MSH5-SAPCD1 readthrough (NMD candidate)
  ENST ID: ENST00000496211
  CDS Start-End: 1-88

SEQ ID NO: 155509 - DNA, 950 bp, Homo sapiens; identical to SEQ ID NO: 155493
  Payload ID: 10572
  Gene Symbol: MSH5-SAPCD1
  Gene Name: MSH5-SAPCD1 readthrough (NMD candidate)
  ENST ID: ENST00000465533
  CDS Start-End: 1-88

SEQ ID NO: 155510 - DNA, 2217 bp, Homo sapiens; identical to SEQ ID NO: 155495
  Payload ID: 10572
  Gene Symbol: MSH5-SAPCD1
  Gene Name: MSH5-SAPCD1 readthrough (NMD candidate)
  ENST ID: ENST00000476578
  CDS Start-End: 1-793

SEQ ID NO: 155511 - DNA, 950 bp, Homo sapiens; identical to SEQ ID NO: 155493
  Payload ID: 10572
  Gene Symbol: MSH5-SAPCD1
  Gene Name: MSH5-SAPCD1 readthrough (NMD candidate)
  ENST ID: ENST00000490634
  CDS Start-End: 1-88

SEQ ID NO: 155512 - DNA, 951 bp, Homo sapiens
  Payload ID: 10572
  Gene Symbol: MSH5-SAPCD1
  Gene Name: MSH5-SAPCD1 readthrough (NMD candidate)
  ENST ID: ENST00000477722
  CDS Start-End: 1-88
tatgaaactggatttggaagatcctaacctggacttgaacgttttcatgagccaggaagtgctgcctgctgccaccagcatcctctgagagtccttccagtgtcctccccagcctcctgagactccgctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaat

SEQ ID NO: 155513 - DNA, 2421 bp, Homo sapiens
  Payload ID: 10573
  Gene Symbol: MSS51
  Gene Name: MSS51 mitochondrial translational activator
  Uniprot ID: Q4VC12
  ENST ID: ENST00000299432
  CDS Start-End: 67-1449
atttcacttggaggaaagagagaaggaaggaagctgaggacttagcagggtatcactggacaggccatggctccacggtcccggcgacgaaggcacaagaaacctccctcatcagtggctcccatcatcatggccccaaccacaattgtgacccctgtgcctctgaccccctcaaaacctggccctagcattgacacacttggcttcttctccttggatgataatgttcctggcctatcgcagctgatccttcaaaagctgaacatgaaaagctatgaagaatataagttggtggtagatgggggtacccccgtatcaggctttggatttcgatgtcctcaagaaatgttccagaggatggaagacacatttcgattctgtgctcactgtagagcactccctagtgggctttcagactccaaggttctccggcactgtaagaggtgcagaaatgtctattactgtggtccagagtgccagaagtcagactggcccgcacacaggagggtttgtcaagagcttcgtcttgtggctgtggaccgtctcatggaatggcttctggtcacaggtgattttgttctaccctcaggaccttggccatggccacctgaagctgtacaggactgggactcctggttttctatgaaggggttacacctagatgctacattggatgctgtgctagttagtcatgctgtgaccaccttatgggccagtgtaggacggccaaggccagacccggatgtcctgcagggatctttgaagcggctgctgacagatgtcctgtcacggcccttgactctaggcctaggacttagggccttggggatagatgttaggaggactgggggaagcacagtgcatgtggttggtgcttcccatgtggagacatttcttactcgcccaggggactatgatgagcttggttacatgtttcctgggcaccttggactccgtgtggtcatggtgggtgtagatgtagctactggcttttcacagagcacctcaacttcacccctggaacctggcacaattcagcttagtgcccacaggggcctctaccatgacttctgggaggagcaagtagagaccgggcagacacaccatccagatttggtggcggcattccatccaggttttcattcctccccagacttgatggaggcttggctgcccaccctgctgctacttcgtgactataagattcctacattgattactgtttacagccatcaggagttggtatcctctttgcagattctggtggaactggatacacacatcactgcctttgggtctaatcctttcatgtccctcaaacctgaacaggtctattccagtcccaacaagcagccagtatactgcagtgcatactatatcatgtttcttggaagctcctgtcagctggataataggcaattagaagagaaagtggacggcgggatttaaatagatcataactggacatctggaaaacggggagtttgtgatgaaattaccctgctaatgccaggttcttgcaaactttgaaaaacattatattctaaacctcatttactgtttgggtaaaaattctaagctgaatgagagtttctgtataacataactggtttctttctttttttgagatggagtcttgctctgttgcccaggctggagtgcagcggcatgatctcgactcactgcagcctccgcctcctgggttcaagtggttctcctgcctcagcctccctagtagctgggattacaggtgcacaccaccacacctggctaatttttgtatttttagcagacagggtttcaccatgttggccaggctcgtatcaaacccttgaccccaggtgatctgcctgcctcagcctcccaaagttctgggattacaggcatgagccaccatgcccagccaatgtaactggtttctaagagtttagccacagtagcttctagagataggaaattagatttagtgggtgggaagaggccctgatgctggtctttccagagcttatagttgctaacacttttctttgtaaagaagtttaccttttgactggaaccagatggcactgagaaaaagaatgagaaccaccttattcttctgaaaaagactttcttctcatccagtaatttgggctaaaaaatggaaagatgttgatgacttgaagtgatgcaagaatggacaagtcagggaagtcattgggaacatggatgaggttgtaagcattggtacagtgtcctgtttcctgacttttttgagagaaatgtctacttttcctgttttctcttggggacttttgaccctagagtagccctggtgttatattttagatatcccaagctatatcagactttacctgaatatactggagttacttattatcccccattctataccccaataaactcagtttggggcttctt

SEQ ID NO: 155514 - DNA, 1510 bp, Homo sapiens
  Payload ID: 10573
  Gene Symbol: MSS51
  Gene Name: MSS51 mitochondrial translational activator
  Uniprot ID: Q4VC12
  ENST ID: ENST00000372912
  CDS Start-End: 4-1386
gccatggctccacggtcccggcgacgaaggcacaagaaacctccctcatcagtggctcccatcatcatggccccaaccacaattgtgacccctgtgcctctgaccccctcaaaacctggccctagcattgacacacttggcttcttctccttggatgataatgttcctggcctatcgcagctgatccttcaaaagctgaacatgaaaagctatgaagaatataagttggtggtagatgggggtacccccgtatcaggctttggatttcgatgtcctcaagaaatgttccagaggatggaagacacatttcgattctgtgctcactgtagagcactccctagtgggctttcagactccaaggttctccggcactgtaagaggtgcagaaatgtctattactgtggtccagagtgccagaagtcagactggcccgcacacaggagggtttgtcaagagcttcgtcttgtggctgtggaccgtctcatggaatggcttctggtcacaggtgattttgttctaccctcaggaccttggccatggccacctgaagctgtacaggactgggactcctggttttctatgaaggggttacacctagatgctacattggatgctgtgctagttagtcatgctgtgaccaccttatgggccagtgtaggacggccaaggccagacccggatgtcctgcagggatctttgaagcggctgctgacagatgtcctgtcacggcccttgactctaggcctaggacttagggccttggggatagatgttaggaggactgggggaagcacagtgcatgtggttggtgcttcccatgtggagacatttcttactcgcccaggggactatgatgagcttggttacatgtttcctgggcaccttggactccgtgtggtcatggtgggtgtagatgtagctactggcttttcacagagcacctcaacttcacccctggaacctggcacaattcagcttagtgcccacaggggcctctaccatgacttctgggaggagcaagtagagaccgggcagacacaccatccagatttggtggcggcattccatccaggttttcattcctccccagacttgatggaggcttggctgcccaccctgctgctacttcgtgactataagattcctacattgattactgtttacagccatcaggagttggtatcctctttgcagattctggtggaactggatacacacatcactgcctttgggtctaatcctttcatgtccctcaaacctgaacaggtctattccagtcccaacaagcagccagtatactgcagtgcatactatatcatgtttcttggaagctcctgtcagctggataataggcaattagaagagaaagtggacggcgggatttaaatagatcataactggacatctggaaaacggggagtttgtgatgaaattaccctgctaatgccaggttcttgcaaactttgaaaaacattatattctaaacctcatttactgtttgggtaaaaat

SEQ ID NO: 155515 - DNA, 1991 bp, Homo sapiens
  Payload ID: 10573
  Gene Symbol: MSS51
  Gene Name: MSS51 mitochondrial translational activator
  ENST ID: ENST00000487126
  CDS Start-End: 66-611
tttcacttggaggaaagagagaaggaaggaagctgaggacttagcagggtatcactggacaggccatggctccacggtcccggcgacgaaggcacaagaaacctccctcatcagtggctcccatcatcatggccccaaccacaattgtgacccctgtgcctctgaccccctcaaaacctggccctagcattgacacacttggcttcttctccttggatgataatgttcctggcctatcgcagctgatccttcaaaagctgaacatgaaaagctatgaagaatataagttggtggtagatgggggtacccccgtatcaggctttggatttcgatgtcctcaagaaatgttccagaggatggaagacacatttcgattctgtgctcactgtagagcactccctagtgggctttcagactccaaggttctccggcactgtaagaggtgcagaaatgtctattactgtggtccagagtgccagaagtcagactggcccgcacacaggagggtttgtcaagagcttcgtcttgtggctgtggaccgtctcatggaatggcttctggtcacagagcacctcaacttcacccctggaacctggcacaattcagcttagtgcccacaggggcctctaccatgacttctgggaggagcaagtagagaccgggcagacacaccatccagatttggtggcggcattccatccaggttttcattcctccccagacttgatggaggcttggctgcccaccctgctgctacttcgtgactataagattcctacattgattactgtttacagccatcaggagttggtatcctctttgcagattctggtggaactggatacacacatcactgcctttgggtctaatcctttcatgtccctcaaacctgaacaggtctattccagtcccaacaagcagccagtatactgcagtgcatactatatcatgtttcttggaagctcctgtcagctggataataggcaattagaagagaaagtggacggcgggatttaaatagatcataactggacatctggaaaacggggagtttgtgatgaaattaccctgctaatgccaggttcttgcaaactttgaaaaacattatattctaaacctcatttactgtttgggtaaaaattctaagctgaatgagagtttctgtataacataactggtttctttctttttttgagatggagtcttgctctgttgcccaggctggagtgcagcggcatgatctcgactcactgcagcctccgcctcctgggttcaagtggttctcctgcctcagcctccctagtagctgggattacaggtgcacaccaccacacctggctaatttttgtatttttagcagacagggtttcaccatgttggccaggctcgtatcaaacccttgaccccaggtgatctgcctgcctcagcctcccaaagttctgggattacaggcatgagccaccatgcccagccaatgtaactggtttctaagagtttagccacagtagcttctagagataggaaattagatttagtgggtgggaagaggccctgatgctggtctttccagagcttatagttgctaacacttttctttgtaaagaagtttaccttttgactggaaccagatggcactgagaaaaagaatgagaaccaccttattcttctgaaaaagactttcttctcatccagtaatttgggctaaaaaatggaaagatgttgatgacttgaagtgatgcaagaatggacaagtcagggaagtcattgggaacatggatgaggttgtaagcattggtacagtgtcctgtttcctgacttttttgagagaaatgtctacttttcctgttttctcttggggacttttgaccctagagtagccctggtgttatattttagatatcccaagctatatcagactttacctgaatatactggagttacttattatcccccattctataccccaataaactcagtttggggcttcttaa

SEQ ID NO: 155516 - DNA, 1735 bp, Homo sapiens
  Payload ID: 10574
  Gene Symbol: MLST8
  Gene Name: MTOR associated protein, LST8 homolog
  ENST ID: ENST00000301724
  CDS Start-End: 75-1058
gtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactggtgagccccgccctggcctcccccatccctggcccccggcgctggcctccagagccagcccacctcggctgcagcttcccctctgctggggccgcctgcttggcctgcacctgcgctcttagccctgcacaatctccccctccagcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaa

SEQ ID NO: 155517 - DNA, 1861 bp, Homo sapiens
  Payload ID: 10574
  Gene Symbol: MLST8
  Gene Name: MTOR associated protein, LST8 homolog
  Uniprot ID: Q9BVC4
  ENST ID: ENST00000382450
  CDS Start-End: 365-1342
agcgcgacccgacagcccgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactccgtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgc

SEQ ID NO: 155518 - DNA, 1691 bp, Homo sapiens
  Payload ID: 10574
  Gene Symbol: MLST8
  Gene Name: MTOR associated protein, LST8 homolog
  Uniprot ID: Q9BVC4
  ENST ID: ENST00000397124
  CDS Start-End: 191-1171
cgcagcccgcccctgcggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 155519 - DNA, 1135 bp, Homo sapiens
  Payload ID: 10574
  Gene Symbol: MLST8
  Gene Name: MTOR associated protein, LST8 homolog
  ENST ID: ENST00000565687
  CDS Start-End: 88-438
tggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcagaggctgagacagggagcttcctgtgggcgacttactgagagaagtgaggacaggaggagagtgaattgcatcagagcgcgagtcctgccttgagcccggagccagcttgttattccccttccaccagccactggcttaggctccctgctggagcagagggccctgcgtcccaagtatttcccaagaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcact

SEQ ID NO: 155520 - DNA, 1044 bp, Homo sapiens
  Payload ID: 10574
  Gene Symbol: MLST8
  Gene Name: MTOR associated protein, LST8 homolog
  ENST ID: ENST00000570224
  CDS Start-End: 344-562
aaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagcc

SEQ ID NO: 155521 - DNA, 792 bp, Homo sapiens
  Payload ID: 10574
  Gene Symbol: MLST8
  Gene Name: MTOR associated protein, LST8 homolog
  ENST ID: ENST00000569457
  CDS Start-End: 185-792
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcat

SEQ ID NO: 155522 - DNA, 1588 bp, Homo sapiens
  Payload ID: 10574
  Gene Symbol: MLST8
  Gene Name: MTOR associated protein, LST8 homolog
  Uniprot ID: Q9BVC4
  ENST ID: ENST00000565250
  CDS Start-End: 133-1113
cccgcgcgtgactcccccctgccggctgcggaggtgggggggggacggcgcccccgccgtgtgcgtggggcggggatggagcacgcgccctggagccccggagccagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccag

SEQ ID NO: 155523 - DNA, 1565 bp, Homo sapiens
  Payload ID: 10574
  Gene Symbol: MLST8
  Gene Name: MTOR associated protein, LST8 homolog
  ENST ID: ENST00000566835
  CDS Start-End: 171-767
cttgcgcacgcgcagcccgcccctgcggcagagtggcgcccgcgcgtgactcccccctgccggctgcggaggtgggggggggacggcgcccccgccgtgtgcgtggggcggggatggagcacgcgccctggagccccggagccagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaagcag

SEQ ID NO: 155524 - DNA, 733 bp, Homo sapiens
  Payload ID: 10574
  Gene Symbol: MLST8
  Gene Name: MTOR associated protein, LST8 homolog
  ENST ID: ENST00000563107
  CDS Start-End: 104-499
gctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgtgcgtgc

SEQ ID NO: 155525 - DNA, 564 bp, Homo sapiens
  Payload ID: 10574
  Gene Symbol: MLST8
  Gene Name: MTOR associated protein, LST8 homolog
  ENST ID: ENST00000563179
  CDS Start-End: 412-564
actggagagctagagagctgggggtaaaaggcagatgactggggttgcggaatgagtgggaggtgaggacgtggaactagaaaaatggtgaggaccgctctttgaagaagataatttgggattgttttatggtgtttttttaaaggctaaccggcaggaaggagaggaggtgaaggtataggaaggaaggctccatgggaactatggcctggtcaagggacaagatgcaccccctctgcggccagaggaaggggtgcagccagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcaca

SEQ ID NO: 155526 - DNA, 855 bp, Homo sapiens
  Payload ID: 10574
  Gene Symbol: MLST8
  Gene Name: MTOR associated protein, LST8 homolog
  ENST ID: ENST00000567623
  CDS Start-End: 115-465
gactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcagaggctgagacagggagcttcctgtgggcgacttactgagagaagtgaggacaggaggagagtgaattgcatcagagcgcgagtcctgccttgagcccggagccagcttgttattccccttccaccagccactggcttaggctccctgctggagcagagggccctgcgtcccaagtatttcccaagaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacat

SEQ ID NO: 155527 - DNA, 581 bp, Homo sapiens
  Payload ID: 10574
  Gene Symbol: MLST8
  Gene Name: MTOR associated protein, LST8 homolog
  ENST ID: ENST00000562479
  CDS Start-End: 83-581
ctcgctccggctcccctcgccgtcctggacacggcggagtgcggagccgcccgtaagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcagttcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagacc

SEQ ID NO: 155528 - DNA, 575 bp, Homo sapiens
  Payload ID: 10574
  Gene Symbol: MLST8
  Gene Name: MTOR associated protein, LST8 homolog
  ENST ID: ENST00000562851
  CDS Start-End: 85-303
gactcgctccggctcccctcgccgtcctggacacggcggagtgcggagccgcccgtaagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacag

SEQ ID NO: 155529 - DNA, 947 bp, Homo sapiens
  Payload ID: 10574
  Gene Symbol: MLST8
  Gene Name: MTOR associated protein, LST8 homolog
  ENST ID: ENST00000565717
  CDS Start-End: 79-297
cggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcacctgcatcacttgtacctcttgcccccggatttcccttctgctggcctttgtcatgctgtctctctagctggtgcccttctcctgtctacttccgttggccatcggcatcctccaggaaggagaatttgagtccttggccaggcgtggcctcctgttcttggcttgccagggaaactgctatgtctggaatctgacggggggcattggtgacgaggtgacccagctcatccccaagactaagatccctgcccacacgcgctacgccctgcagtgtcgcttcagccccga

SEQ ID NO: 155530 - DNA, 1870 bp, Homo sapiens
  Payload ID: 10574
  Gene Symbol: MLST8
  Gene Name: MTOR associated protein, LST8 homolog
  Uniprot ID: Q9BVC4
  ENST ID: ENST00000569417
  CDS Start-End: 355-1335
gacagcccgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaa

SEQ ID NO: 155531 - DNA, 939 bp, Homo sapiens
  Payload ID: 10574
  Gene Symbol: MLST8
  Gene Name: MTOR associated protein, LST8 homolog
  ENST ID: ENST00000562352
  CDS Start-End: 115-939
gactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcagttcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcc

SEQ ID NO: 155532 - DNA, 1861 bp, Homo sapiens
  Payload ID: 10574
  Gene Symbol: MLST8
  Gene Name: MTOR associated protein, LST8 homolog
  Uniprot ID: Q9BVC4
  ENST ID: ENST00000564088
  CDS Start-End: 362-1342
gtagtgggtcagggagggcaccggaacagcgcgacccgacagcccgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgc

SEQ ID NO: 155533 - DNA, 854 bp, Homo sapiens
  Payload ID: 10574
  Gene Symbol: MLST8
  Gene Name: MTOR associated protein, LST8 homolog
  ENST ID: ENST00000567282
  CDS Start-End: 82-297
cggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactccgtgaatgccttggaggtcacaccggaccgcagcatgattgctgctgcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgtgcgtgcagggcctgctggcccgggaggggacctgcctgggctgggggctggagaggggagggg

SEQ ID NO: 155534 - DNA, 1553 bp, Homo sapiens
  Payload ID: 10575
  Gene Symbol: MTRNR2L1
  Gene Name: MT-RNR2-like 1
  Uniprot ID: P0CJ68
  ENST ID: ENST00000540040
  CDS Start-End: 952-1026
cccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaa

SEQ ID NO: 155535 - DNA, 1530 bp, Homo sapiens
  Payload ID: 10576
  Gene Symbol: MTRNR2L10
  Gene Name: MT-RNR2-like 10
  Uniprot ID: P0CJ77
  ENST ID: ENST00000545075
  CDS Start-End: 927-1001
caaacctcactaaaaatattattaaattatcttaatcaaaccatttaccctagacaaaagtataggcaatagaaatttttaccccggcgcaatagacatagaaccgtcagggaaagatgaaagaactgtatcaagcatcaaaaagcaaagacaaacccttatatcttctgcataatgtattaactagaaataactttacacagagaattatagccaagttccccaaaaccagacgagctaccgaagaacagctgaaagagcacacttacctatgtggcaaaatagtgagaagattcataagtagcagtgacaagcctaccgagcctggtgatagctggttgtccaagatgggatcttaattcaactttaaacttacccacagaattacttaatctccccataagtttagacagctctttagaccctaggaaacaaccttcctacagagagtaaaaaatatttccaccatagttggcccaaaagcaatcaccaattaagaaagcgtttaagctcaacatctatcttaaattctagtcactctactgaactcctaacatcacattggactaatctattacttaatagaagcaataatgttaatataagtaatatgaaaacattctccattgcataagcttacatcagactggaataacccactgacagttagcctaatattaataaacgatataataagctctttattatttacactgttaacccaacacaggtatgctctaaggaaagaatacaaaaagtaaaaggaactccgcaaattttaccccgcctgtttaccaaaaacatcacctctagcattaccagtattagaggcactgcctgcccagtgacatacgttcaatggccgcagtatcctgactgtgcaaaggtagcataatcacttgttccttaaataggaacttgtatgaatgaccacacgagggttcagctgtctcctacttttaatcagggaaattgacctatccgcgaagaggcggatataaacaaataagacgagaagaccctatgtatggagctttaatttattaatgcaaataaaaacttaagcctacaggccctagcctactatccctgcattaaaatttttggttggggtgacctcagagcataattcaacctccgagcaacctaaactaagactgcactagcctaagcaagttaatatatattgacccgataatttgatcaacggagtaagttaccctagggataacagcgcaatcctattctagagtccatatcaacaatagggtttacaatctcgatgttggatcaggacatcctaatggtgtcaccgctattaggggttcgtttgttcaacaattaaagtcctacgtgatgtgagttcagaccagagtaatccaggtcggtttctatctatttaacatttcccctagtatgaaaggacaagagaaatagggcccacttcataaagtgccctcgctccacagatgatgctatctcaatctaacaaatcatcacataccctacccaagaacagggtttgttaag

SEQ ID NO: 155536 - DNA, 1552 bp, Homo sapiens
  Payload ID: 10577
  Gene Symbol: MTRNR2L11
  Gene Name: MT-RNR2-like 11 (pseudogene)
  Uniprot ID: S4R3Y5
  ENST ID: ENST00000604646
  CDS Start-End: 950-1024
cccaaacctcgctaaaaatattattaaatcatctcaatcaaaccatttaccttagacgaaagtgtaggcgatagaaatttatgccttgatgcagtagatacactaccataagggaaagatgaaagaactaaattaagcactaaaaagcaaagataaagtcttttaccttctgcataatgtactagctagaaataacttgacacagagaaccatagccaagtctcccgaaaccagacgagctactcaagaacagctgaaagagcacacccacctgtgtggcaaaatagtgggaaaattcatgagtagtggtgacaagcctacggagccttgtgatagctggttgtccaagatagaatcttagttcaactttaaacttacccacagaattacttaagctccctgtaagtctgttagtctaaagagggacagctctttagaccctagggaataacttttctgtagaaagtaaaaaatattacccccatagttgacccacaaacagccaccaattaagaaagcgttcaacctcaacatctaattatcttaaattctaatcactttactgaactcctaacaacaccttggactaatctgttatttaatagaagcaataatgttcacataagtaacgtgaaaatattctccattgcataagcttatatcagactggaataacccactgacaactaacagcctaatattaataagcaatataacaagcaccttattatttattctgttaatccaacacaggcatgctctaaggaaagattacaaaaagtaaaaggaactctgcaaatcttactcggcctgtttaccaaaaatatctcctctagcatttccagtattagaggtactgcctgcccactgacatatgttcaacggccacggtatcctgactgtgcaaaggtagcataatcacttgttccctaaatagggacttttacgaatggccacacgagggttcagctgtcttttacttgtaatcagtgaaattgacctatccgtgaagaggtgggtataaacaaataagaaaagaagaccctatggagctttaactcattaatgcaaataaaacttcaaaaagcctacaggccttagcatactgtctgtgcattaaaattttggttggggtgacctcggagtataattcaacctccaaacagcctagactaagaccgcactagtgtaagcgagctgacacacattgattcgataatttgatcaacagaagaagttaccctaggggtaacagcacaatccttttctagagtccatatagacaatagggtttacaacctcaatgttggatcaggccatcctaatggcgtagctactattaagggttcatttgttcaatgattaaagtcctacgtgatctgagttcagaccagagtaatccaggtcagtttctatctatttaacatttctcctagtacagaaggacaagagaaatagggcccacttcataaagtgccctcgccccatagatgatattatctcaatctaacaaatcatcacacaccctacccaagaacagggtttgttaaga

SEQ ID NO: 155537 - DNA, 1049 bp, Homo sapiens
  Payload ID: 10578
  Gene Symbol: MTRNR2L12
  Gene Name: MT-RNR2-like 12
  Uniprot ID: P0DMP1
  ENST ID: ENST00000600213
  CDS Start-End: 964-1038
agccaaacctagccctaaacccgttccaccttactatcaaataaccttaaccaaaccatttacccaaataaagtataggcgatagaaattgtaaaccggcgcaatagatatagtaccgcaagggaaagatgaaaaattataaccaagcataatacagcaaggactaacccctgtaccttttgcataatgaattaactagaaataactttgcaaagagaaccaaagctaaggcccccgaaaccagacgagctacctaagaacagctaaaagagcacacccgtctatgtagcaaaatagtgggaagatttataggtagaggcgacaaacctatcgagcctggtgatagctggttgtccaagatagaatcttagttcaactttaaatttacctacagaaccttctaaatccccttgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacccatcgtctaaaaaatcccaaacatacaactgagctccttacactcaattggaccaatctattaccttatagaagaactaatgttagtataagtaacatgaaaacattctcctccgcataagcctacatcagaccaaaatattaaactgacaattaacagcccaatatctacaatcaaccaacaagccattattaccctcactgttaacccaacacaggcatgcccacaaggaaaggttaaaaaaagtaaaaggaactcggcaaatcttaccccgcctgtttaccaaaaacatcacctctagcattatcagtattagaggcaccgcctgcccggtgacatatgtttaacggccgcggtaccctaaccgtgcaaaggtagcataatcacttgttccttaaatagggacttgtatgaatggctccacgagggttcagctgtctcttactttcaaccagtgaaattgacctacccgtgaagaggcgggcataacatagcaagac

SEQ ID NO: 155538 - DNA, 1445 bp, Homo sapiens
  Payload ID: 10579
  Gene Symbol: MTRNR2L13
  Gene Name: MT-RNR2-like 13
  Uniprot ID: S4R3P1
  ENST ID: ENST00000604093
  CDS Start-End: 926-1000
aatattatcaaactatcttaatcaaaccatttacattaaacgaaagtataggtgatagaaatttttaccctggtgtagtagacatagtaccgtaaaagaaaggtgaaagaactatataaagcactaaaaagcaaagacaagctcttataccttccgcataatgtattaactagaagtaactttacacagaggattatagccaagtcccccaaaaccagatgagctacccaagaacaactgaagagtacacccatctatgtggcaaaatagttgggagattcatgactagcggtgacaagcctaccaagcctggtgatagttggttgtccaacgtggaatcttagttcaactttaaacttacccacagaattatttactctccctgtaaatttagctgttagtctaagagggacagctctgtagaccctaggaaacgacgttcctacagagagtaaaaaatactaccaccatagttggcccaaacgcagccaccaattaagaaagcatttaaagctcaacatctaactatcttcaattctaatcactctactgaactcctaacatcatactggactaatcaattacttaatagaaccaataatgttaatataaacattctccattgcatacgtttacatcagactggaataacccactgacagttaacaacctaatattaataaatgatataataagcaccctattatttacactgttaacccaactaaggtatgctctaaggaaagattgcaaaaagtaagaggaacatgacaaatcttaccccacctgtttaccaaaaacatcacctctagcattaccagttttagagtcactgcctgcccggtgacatatgttcaacggccatggtatcctgaccgtgcaaaggtagcataatcgcttgttccctaaatagggacttgtatgaatggacacacaagggttcagctgtctcttacttttaatcagtgaaattgacctatctgtgaagaggcggatataaacaaatgagactagaaaaccctatggagctttaattcattaatgcaaataaaaacccaaacaagtctagaggccctggcctactatccctgcattaaaaattttggttggggtgagctcggagcatagttcaacctccgaacaacctaaactaagactgcagtagtctaagcgagttagtacacattgaccaaataattcaatcaacggaataaattaccctacggataaaagtattgacaatagggtttacaacctcgatgttggatgaggacatcctaatggtgtagccgctattaagggttcgtttgtttaacggttaaagttctatgtgatctgagttcagacctgagtaatccaggtcagtttctatctatataacatttatcttagtatgaaaggacaagagaaatagggcccacttcataaagtgccctcactccata

SEQ ID NO: 155539 - DNA, 1539 bp, Homo sapiens
  Payload ID: 10580
  Gene Symbol: MTRNR2L3
  Gene Name: MT-RNR2-like 3
  Uniprot ID: P0CJ70
  ENST ID: ENST00000543500
  CDS Start-End: 942-1016
cccaaacctcgctaaaaatattatcaaactatcttaatcaaaccatttaccttaaacaaaagtataggcgatagaaatttctaccctggtagatatttctggcaatagacacagtactgtaagggaaggatgaaagaactgtattgaggactaaaaagcaaagacaagcccttataccttctgcataatgcattaactagaaataactttacatagaactatggccaagtcccccgaaaccagacgagctacccaagaatagctgaaagagcacactcacctatgtggcaaaacagtgggaagattcatgagtagcggtgacacgcctaccgagcctggtgatagctggctggcttagttcaactttcaacttacccacagaattacttaaactccctgtaagtttaactgttagtctagagagacagacagctctttagacccttcctacagagagtaaaaaacattaccaccacagttggcccaaaagcagccactaattaagaaagcatttaagctcaatatctaactatcttaaattctaaccagtctactgaactcctaacatcacattggactaatctattacttaatagaagcagtaatgttaatgtaagtaagatgaagacattctccattgcataagcttacatcagacgggagtaacccactgacagttaacatcccaatattaataaatgatataataaacaccgtattatttgcactgttaacccaacacaggcatgctctaaggaaacattacaaaaaaataaaaggaactcagcaaatcttaccccgcctgtttaccaaaaacatcacctctagcattaccagtattagaggcactatctgcccagtgacatatattcaacagctgtggtatcctgaccgtgcgaaggtagcataatcacttgttctctaaatagggacttgaatgaatggccacacgaaggttcagctgtctcttactttcaaccagtgaaattgatctatccgtgaagaggcggatataaacaaataagacgagaaaaccttatggagctttaattcatcaatgcaaataaaaactccaacaagcctacaggccctagcctcctatccctgcattaaaaattttggttggggtgacctcggagcataattcaacctcctaacaacctaagaccacacaagtctaagtgagttattacacatcgacccaataatttgataaacggagtaagttaccctagggataacagcgcaatcctatactagagtccatatcgacaatagagtttacgacctcgatgttggatcaggacatcctaatggtgtagccgctattaagagtttgtttgttcaatgattaaagtcctatgtgatctcagttcagaccagagtaatccaggtcggtttctacctacttaacattcctcctactacgaaaggacaagagaaatagggcccacttcataaagtgccctcactccatagatgatgccatcccagtctcttaaatcatcacacatcctacccaagaacagggtttgttaa

SEQ ID NO: 155540 - DNA, 1762 bp, Homo sapiens
  Payload ID: 10581
  Gene Symbol: MTRNR2L4
  Gene Name: MT-RNR2-like 4
  Uniprot ID: P0CJ71
  ENST ID: ENST00000399974
  CDS Start-End: 839-925
gggacagctgtttagaccctaggaaataaccttcctccagagagtaaaaaatattaccaccgtagttggcccaaaagcagctaccgattaagaaagcattcaaggccaggtgcggtggctcacacctgtaatcccagcactttgggagaccgaggtgggcagatcatctgaggtcagcagattgagaccagcctgaccaacatggagaaactccatctctactaaaaatacaaaattagccaggcatggtggtgcatgcctgtgatcccagctactcgggagactgaggcaggagaatcgcttgaacccgggactcggaggttgcagtgagccaagattgcgtcactgcactccagcctggacaacaaaagcgaaactccgtctcaaaaaaaaaagaaaaaagaaaaaaagaaagctttcaagctcaacatccaattattttaaatcctaatcactctattgaactcctaacattacattagactaatctattacttaatagaagcaataatgttaatattagtaacacgaagacattctccattgcataagcttatatcaaaccagaatccactgatagttaacagcctaatattaataaagaataaataccctattatttataccattaatccaacacaggtatgctctaaggaaagattacaaaaagtataaggaactcgggaaatcttaccccacctgtttaccaaaaacatcacctctggcttcaccagtattagaggcaccgcctgcccagtgacatatgttcaacagctgcggtatcctgacattgtaaaggtagcataatcacttgttccctaaatagggacttgtatgaatggccacacaagggttcagctgtctcttactttcagtcagtgaaattgacctatccatgaagaggcagtataaacaaataagatgagaagactctatagagctttaattcattaatgcaaatagaaactcaaaaaaagcctacaggccctagcctactatctttgcattaaaaattttggttggggtgcccggcgtggtggctcacgcctataatcccagcactttgggaggctgagacaggcagatcacgaggtcaggagatcgagaccatcccggccaatatggtgaaatcccgtctctactaaaaatacaaaaattagctgggtgtggtggtatgtgcctgtaatcccagctactcaggagactgaggcaggagaatggctttaacccgggaggtggagatagcagtgagccaagatcgtgccactgcactccagcctggcaacagagccagactctgtcttaaaaaataaataaataaaaaacaaaaaaaataaaaattttcttttatttcagagcataattcaacctccaaactacctaaactaagaccgcactagtctaagcaagttaacacacactgacccaataatttgatcaacggaataagttatcctagggataacggcacaatcctattctagggtccatatcaacaacagggtttacagcttcaatgctggatcaggacatcctaatagtgtagccgctattaagggttcgttttttcaactattaaagtcccatgtgatctcagttcagatcggagtaatccaggtcggtttctaactatttaacatttctcctagtacaaaaggacaagagaagcagggcccatttcacaaagcacccttgccaccataaatgatgctgtctcaatctaacaaatcatcacacactctaccatcttaaacagtgttta

SEQ ID NO: 155541 - DNA, 739 bp, Homo sapiens
  Payload ID: 10582
  Gene Symbol: MTRNR2L5
  Gene Name: MT-RNR2-like 5
  Uniprot ID: P0CJ72
  ENST ID: ENST00000512524
  CDS Start-End: 598-672
tagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacagg

SEQ ID NO: 155542 - DNA, 1447 bp, Homo sapiens
  Payload ID: 10583
  Gene Symbol: MTRNR2L6
  Gene Name: MT-RNR2-like 6
  Uniprot ID: P0CJ73
  ENST ID: ENST00000604952
  CDS Start-End: 960-1034
aactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcgttcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctcc

SEQ ID NO: 155543 - DNA, 1447 bp, Homo sapiens
  Payload ID: 10583
  Gene Symbol: MTRNR2L6
  Gene Name: MT-RNR2-like 6
  Uniprot ID: P0CJ73
  ENST ID: ENST00000633925
  CDS Start-End: 960-1034
aactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctcc

SEQ ID NO: 155544 - DNA, 1535 bp, Homo sapiens
  Payload ID: 10584
  Gene Symbol: MTRNR2L7
  Gene Name: MT-RNR2-like 7
  Uniprot ID: P0CJ74
  ENST ID: ENST00000544824
  CDS Start-End: 931-1005
tattatcaaactatcttaatcaaaccatttaccttaaataaaggtataggtgatagaaatttttagcctggcacaatagacttagtacagtaagggaaagatgaaagaactgtatcaagcactgaaaagcaaagacaagcccttatgccttctgcataatgtattaaccagaaataactttacacagagaactatagccaagtcccccaaaaccagccaagctacccaagaacagctgaaagagcacactcacctatgtggcaagatagtgggaagattcatgagtagaagtgacaaggctatggagcctggtgatagctggttgtccaagatagactcctagttcaactttaagcttatacacagaattacttaacctccctgtaagtttaactgttagtctaaagagggacagctctttagaccctaggaaacaaccttcctacagaaaataaaaaatattaccaccacagttggcccaaaagcagccaccaattaagaacatgtttaagttcaacatctatcttaaattctaatcactctactgaactcctaacatcacactggactaatctattacttaatagacacaataatgttagtataagtaacatgaagacattctccattgcataagcttacatcagaccagaataatccactgacagttaacagcctaatattaataaacaatataataaacaccctattatttacactgttaacccaacacaggtatgctctaaggaaagattacaaaaagtaaaaggaactcggcaaatcatactctgcctgtttaccaaaaacacacctctagcattaccagtatttgaggcactgcctgcccagtgacatttgttcaacagccacagtatcctgaccatgcaaaagtagcataatcacttgttccctaaatagggacttgtatgaatggccacaggagggttcggctgcctcttacttttaatcagggaaattgacctatccgtgaagaggcagatataaacaaataagatgagaagctccctatggagctttaattcattaatgcaaattaaaactcaaacaagcctacaggctctagcctactattcttgcattaaaaattttggttggggtgaccttggagcataattcaacctctgaacaacctacactaagactgcactagtctaagtgagttaatacatatggacccaataatttgatcaacagagtaaggtaccctagggataacagcacaatccattctacagttcatattgacaatagggtttatgaccttgatgttagatcaggacatcctaatggtgtaaccactgttaaggattcatttattcaatgattaaagtcaattaatgtgatctgagttcagactggagtaatccaggttggtttctatctatttaacatttctccaagtatgaaaggacaagagaaatagagtccctttcataaagtgccctcacttcatagaggatgctatctcaatctaaaaaatcatcaccaccctacccaagaacagggtttgttaa

SEQ ID NO: 155545 - DNA, 1303 bp, Homo sapiens
  Payload ID: 10585
  Gene Symbol: MTRNR2L8
  Gene Name: MT-RNR2-like 8
  Uniprot ID: P0CJ75
  ENST ID: ENST00000536684
  CDS Start-End: 964-1038
agccaaacctagccccaaacccattccaccttactaccgaacagctttaaccaaatcatttacccaaataaagtataggcgatagaaattgtaaatcggcgcaatagatatagtaccgcaagggaaagatgaaaaattgcaaccaagcataatacagcaaggactaatccctgtaccttctgcataatgaattaactagaaataactttgcaaagagaaccaaagctaagacccccgaaaccagacgagctacctaagaacagctaaaagagcacacccgtctatgtagcaaaatagtgggaagattcgtaggtagaggcgacaaacctaccgagtctggtgatagctggttgtccaagacagaatcttagttcaactttaaatttacccacagaaccctccaaatccccctgtaaatttaactgttagtccaaagaggaacagctctttggacactaggaaaaaaccttgtaaagagagtaaaaaatttaatacccacagtaggcctaaaagcagccaccaattaagaaagcgttcaagctcgacacctgtcatctaaaaaatcccaaacacataactgaactccttgcacccaattggaccaatctattaccctatagaagagctaatgttagtataagtaacatgaaaacattctcctccgcataagcctacatcagaccaaaatattaaactgacaattaacagcccaatatctataaccaaccaacaagccattattacccccactgttaacccaacacaggcatgcccacaaggaaaggttaaaaaaagtaaaaggaactcggcaaatcttaccccgcctgtttaccaaaaacatcacctctagcattctcagtattagaggcaccgcctgcccagtgacatgcgtttaacggccgcggtaccctaactgtgcaaaggtagcataatcacttgttccttaaatagggacttgtatgaatggctccacgagggttcagctgtctcttactttcaaccagtgaaattgacctgcccgtgaagaggcgggcatagtataacaagacgagaagaccctatggagctttaattcattaacgcaaacaacacttaacaagtccacaggccctaaactatcaaacctgcgtgaaaaatttcggttggggcgacctcggagcacaatccgacctccgagcaacacatgccgagacttcaccagtcaaagcgaattaccacgtttaattgatccaataacttgaccaacggaacaagttaccctagggataacagcgcaatcctattctagagtccatatcaacaa

SEQ ID NO: 155546 - DNA, 859 bp, Homo sapiens
  Payload ID: 10586
  Gene Symbol: MUC1
  Gene Name: mucin 1, cell surface associated
  Uniprot ID: P15941
  ENST ID: ENST00000337604
  CDS Start-End: 26-847
cctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155547 - DNA, 648 bp, Homo sapiens
  Payload ID: 10586
  Gene Symbol: MUC1
  Gene Name: mucin 1, cell surface associated
  Uniprot ID: P15941
  ENST ID: ENST00000343256
  CDS Start-End: 25-636
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155548 - DNA, 537 bp, Homo sapiens
  Payload ID: 10586
  Gene Symbol: MUC1
  Gene Name: mucin 1, cell surface associated
  Uniprot ID: P15941
  ENST ID: ENST00000342482
  CDS Start-End: 25-525
ctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155549 - DNA, 1107 bp, Homo sapiens
  Payload ID: 10586
  Gene Symbol: MUC1
  Gene Name: mucin 1, cell surface associated
  ENST ID: ENST00000338684
  CDS Start-End: 73-798
cgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 155550 - DNA, 543 bp, Homo sapiens
  Payload ID: 10586
  Gene Symbol: MUC1
  Gene Name: mucin 1, cell surface associated
  Uniprot ID: P15941
  ENST ID: ENST00000368389
  CDS Start-End: 25-531
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155551 - DNA, 804 bp, Homo sapiens
  Payload ID: 10586
  Gene Symbol: MUC1
  Gene Name: mucin 1, cell surface associated
  Uniprot ID: P15941
  ENST ID: ENST00000368390
  CDS Start-End: 25-792
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155552 - DNA, 1032 bp, Homo sapiens
  Payload ID: 10586
  Gene Symbol: MUC1
  Gene Name: mucin 1, cell surface associated
  Uniprot ID: P15941
  ENST ID: ENST00000368392
  CDS Start-End: 51-845
gcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 155553 - DNA, 937 bp, Homo sapiens
  Payload ID: 10586
  Gene Symbol: MUC1
  Gene Name: mucin 1, cell surface associated
  Uniprot ID: P15941
  ENST ID: ENST00000368393
  CDS Start-End: 51-647
gcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 155554 - DNA, 516 bp, Homo sapiens
  Payload ID: 10586
  Gene Symbol: MUC1
  Gene Name: mucin 1, cell surface associated
  Uniprot ID: P15941
  ENST ID: ENST00000368396
  CDS Start-End: 25-504
ctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155555 - DNA, 729 bp, Homo sapiens
  Payload ID: 10586
  Gene Symbol: MUC1
  Gene Name: mucin 1, cell surface associated
  Uniprot ID: P15941
  ENST ID: ENST00000368398
  CDS Start-End: 25-717
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctatcccagcaccgactactaccaagagctgcagagagacatttctgaaatggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155556 - DNA, 1161 bp, Homo sapiens
  Payload ID: 10586
  Gene Symbol: MUC1
  Gene Name: mucin 1, cell surface associated
  ENST ID: ENST00000457295
  CDS Start-End: 51-857
gcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggaatggagggtagaccgagaaaggctggcatagggggaggtttcccaggtagaagaagaagtgtcagcagaccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 155557 - DNA, 927 bp, Homo sapiens
  Payload ID: 10586
  Gene Symbol: MUC1
  Gene Name: mucin 1, cell surface associated
  ENST ID: ENST00000438413
  CDS Start-End: 51-740
gcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 155558 - DNA, 666 bp, Homo sapiens
  Payload ID: 10586
  Gene Symbol: MUC1
  Gene Name: mucin 1, cell surface associated
  ENST ID: ENST00000485118
  CDS Start-End: 1-258
acggaagcagcctctcgatataacctgacgatctcagacgtcagcgtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 155559 - DNA, 1112 bp, Homo sapiens
  Payload ID: 10586
  Gene Symbol: MUC1
  Gene Name: mucin 1, cell surface associated
  ENST ID: ENST00000462317
  CDS Start-End: 1-687
gccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggaatggagggtagaccgagaaaggctggcatagggggaggtttcccaggtagaagaagaagtgtcagcagaccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgc

SEQ ID NO: 155560 - DNA, 4170 bp, Homo sapiens
  Payload ID: 10586
  Gene Symbol: MUC1
  Gene Name: mucin 1, cell surface associated
  ENST ID: ENST00000611571
  CDS Start-End: 73-3861
cgctccacctctcaagcagccagcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgccccccaagcccacggtgtcacctcggccccggacaccaggccggccccgggctccaccgcccccccagcccacggtgtcacctcggccccggacaccaggcccgccccgggctccaccgcccccccagcccacggtgtcacctcggccccggacaccaggtccgccccgggctccaccgcgcccgcagcccacggtgtcacctcggccccggacaccaggtcggtcccgggctccaccgccccccaagcccacggtgtcacctcggccccggacaccaggccggccccgggctccaccgcccccccagcccacggtgtcacctcggccccggacaccaggccggttccgggctccaccgcccccccagcccacggtgtcacctcggccccggacaccaggccggccccgggctccaccgcccccccagcccacggtgtcacctcggccccggacaccaggccggccccgggctccaccgccccccaagcccacggtgtcacctcggccccggacaccaggccggccccgggctccaccgcccccccagcccacggtgtcacctcggccccggacaccaggcccgccccgggctccaccgcccccccagcccacggtgtcacctcggccccggacaccaggcccgccccgggctccaccgcgcccgcagcccacggtgtcacctcggccccggacaccaggccggccccgggctccaccgccccccaagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggcccgccccgggctccaccgcccccccagcccacggtgtcacctcggccccggacaccaggcccgccccgggctccaccgcgcccgcagcccacggtgtcacctcggccccggacaccaggccggccccgggctccaccgccccccaagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccaacccacggtgtcacctcggccccggacaccagtcccgccccgggctccaccgcccccccagcccacggtgtcacctcggccccggacacaaggcccgccccgggctacaccgcgcccgcagcccacggtgtcacctcggccccggacaccaggccggccccgggctccaccgccccccaagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggagagcaggccggccccgggctccaccgcgagagcagcccacggtgtcacctcggccccggagagcaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccgtccccgccgggctccaccgcccccccagcccacggtgtcacctcggccccggacaccaggccggccccgggctccaccgcccccccagtccacggtgtcacctcggccccggacaccaggccggcaccgggctccaccgcccccccagcccacggtgtcacctcggccccggacaccaggccggccccgggctccaccgcccccccagcccacggtgtcacctcggccccggacaccaggccggccccgggctccaccgcacccccagcccacggtgtcacctcggccccggacaccaggcgggccccgggctccaccccggccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 155561 - DNA, 1189 bp, Homo sapiens
  Payload ID: 10586
  Gene Symbol: MUC1
  Gene Name: mucin 1, cell surface associated
  ENST ID: ENST00000462215
  CDS Start-End: 51-458
gcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctgctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacgatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 155562 - DNA, 1811 bp, Homo sapiens
  Payload ID: 10586
  Gene Symbol: MUC1
  Gene Name: mucin 1, cell surface associated
  ENST ID: ENST00000620103
  CDS Start-End: 73-1500
cgctccacctctcaagcagccagcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaa

SEQ ID NO: 155563 - DNA, 1162 bp, Homo sapiens
  Payload ID: 10586
  Gene Symbol: MUC1
  Gene Name: mucin 1, cell surface associated
  ENST ID: ENST00000610468
  CDS Start-End: 51-431
gcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctgctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacgatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 155564 - DNA, 1093 bp, Homo sapiens
  Payload ID: 10586
  Gene Symbol: MUC1
  Gene Name: mucin 1, cell surface associated
  ENST ID: ENST00000614519
  CDS Start-End: 73-444
cgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 155565 - DNA, 667 bp, Homo sapiens
  Payload ID: 10586
  Gene Symbol: MUC1
  Gene Name: mucin 1, cell surface associated
  ENST ID: ENST00000498431
  CDS Start-End: 25-315
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155566 - DNA, 951 bp, Homo sapiens
  Payload ID: 10586
  Gene Symbol: MUC1
  Gene Name: mucin 1, cell surface associated
  ENST ID: ENST00000615517
  CDS Start-End: 73-642
cgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 155567 - DNA, 1101 bp, Homo sapiens
  Payload ID: 10586
  Gene Symbol: MUC1
  Gene Name: mucin 1, cell surface associated
  ENST ID: ENST00000610359
  CDS Start-End: 73-792
cgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctatcccagcaccgactactaccaagagctgcagagagacatttctgaaatggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 155568 - DNA, 1023 bp, Homo sapiens
  Payload ID: 10586
  Gene Symbol: MUC1
  Gene Name: mucin 1, cell surface associated
  ENST ID: ENST00000611577
  CDS Start-End: 73-714
cgctccacctctcaagcagccagcgcctgcctgaatctgttctgccccctccccacccatttcaccaccaccatgacaccgggcacccagtctcctttcttcctgctgctgctcctcacagtgcttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 155569 - DNA, 619 bp, Homo sapiens
  Payload ID: 10586
  Gene Symbol: MUC1
  Gene Name: mucin 1, cell surface associated
  ENST ID: ENST00000467134
  CDS Start-End: 25-267
ctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155570 - DNA, 635 bp, Homo sapiens
  Payload ID: 10586
  Gene Symbol: MUC1
  Gene Name: mucin 1, cell surface associated
  ENST ID: ENST00000471283
  CDS Start-End: 25-474
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 155571 - DNA, 1836 bp, Homo sapiens
  Payload ID: 10586
  Gene Symbol: MUC1
  Gene Name: mucin 1, cell surface associated
  ENST ID: ENST00000612778
  CDS Start-End: 73-1527
cgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 155572 - DNA, 580 bp, Homo sapiens
  Payload ID: 10587
  Gene Symbol: MUC12
  Gene Name: mucin 12, cell surface associated
  ENST ID: ENST00000305119
  CDS Start-End: 1-285
tgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatc

SEQ ID NO: 155573 - DNA, 16737 bp, Homo sapiens
  Payload ID: 10587
  Gene Symbol: MUC12
  Gene Name: mucin 12, cell surface associated
  Uniprot ID: Q9UKN1
  ENST ID: ENST00000379442
  CDS Start-End: 1-16437
atgctggtgatctggattctgacgctggctctccggctctgcgcgtccgttactacagtgacaccagagggctctgctgttcacaaagccatttcccagcagggcacattgtggactggtgaggttttggagaagcagacagtcgagcaagggaagagcactctgagaaggcagaaaaatcatttccacaggtctgcaggggagctacggtgcaggaatgccctgaaagatgagggggcatctgctggatggagcgtgatgtttgctggggagagtgtggtggtgctggtgcatttgtggatgacaggagcacgagtgaagaacctgggcttggtggagtttgctagcccaggggacgacggggatggcagagccgagggctttagcctggggctcccacttagtgagcaggcaagggctgcaggagccagagagaaggagcgtcaggagacagtcataaatcatagcactttctctggtttctctcaaatcacaggctcaacagtaaacaccagtattggaggtaatacaacttctgcatccacacccagttcaagcgacccttttaccacctttagtgactatggggtgtcagtcacatttatcacgggctcaactgcaacaaaacacttccttgacagctccacaaactcaggccacagtgaggaatcaacagtatcccacagcggcccaggtgcaactggaacaacactcttcccttcccactctgcaacctcagtttttgttggagaacctaaaacctcacccatcacttcagcctcaatggaaacaacagcgttacctggcagtaccacaacagcaggcctgagtgagaaatctaccaccttctacagtagccccagatcaccagacagaacactctcacctgcccgcacgacaagctcaggcgtcagtgaaaaatcaaccacctcccacagccgaccaggcccaacgcacacaatagcgttccctgacagtaccaccatgccaggcgtcagtcaggaatctacagcttcccacagcatccccggctccacagacacaacactgtcccctggcactaccacaccatcatcccttggtccagaatctactaccttccacagcagcccaggctacactaaaacaacacgcttacctgacaacaccacaacctcaggcctccttgaagcatctacgcccgtccacagcagcactggatcgccacacacaacactgtccccttccagctctacaacccatgagggagaacctaccaccttccagagctggccaagctcaaaggacacttcgcctgcaccttctggtaccacatcagcctttgttaaactatctacaacttatcacagcagcccgagctcaactccaacaacccacttttctgccagctccacaaccttgggccatagtgaggaatcgacaccagtccacagcagcccagttgcaactgcaacaacacccccacctgcccgctccgcgacctcaggccatgttgaagaatctacagcctaccacaggagcccgggctcaactcaaacaatgcacttccctgaaagctccacaacttcaggccatagtgaagaatcagcaactttccacggcagcacaacacacacaaaatcttcaactcctagcaccacagctgccctagcacatacaagctaccacagcagcctgggctcaactgaaacaacacacttccgtgatagctccacaatctcaggccgtagtgaggaatcaaaagcatcccacagcagcccagatgcaatggcaacaacagtcttacctgccggctctacaccctcagttcttgttggagactcgacgccctcacccatcagttcaggctcaatggaaaccacagcgttacccggcagtaccacaaaaccaggcctcagtgagaaatctaccactttctacagtagccccagatcaccagacacaacacacttacctgccagcatgacaagctcaggcgtcagtgaagaatccaccacctcccacagccgaccaggctcaacacacacaacagcattccctggcagtaccaccatgccaggcctcagtcaggaatctacagcttcccacagcagcccaggccccacagacacaacattgtcccctggcagtaccacagcatcatcccttggtccagaatatactaccttccacagccgcccaggctccactgaaacaacactcttacctgacaacaccacagcctcaggactccttgaagcatctatgcccgtccacagcagcaccagatcgccacacacaacactgtcccctgccggctctacaacccgtcagggagaatctaccacattccatagctggccaagctcaaaggacactaggcctgcacctcctactaccacatcagcctttgttgagccatctacaacctcccacggcagcccgagctcaattccaacaacccacatttctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcgcacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagagatctaccactttccatagtagccccagatcaccagccacaacactctcacctgccagcacgacaagctcaggcgtcagtgaagaatccaccacctcccgcagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagctcaggttcaactgacacagcactgtcccctggcagtaccacagccttatcctttggtcaagaatctacaaccttccacagcaacccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctactgccttccagacccacccagcctcaactcacacaacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctgggcgtcggtgaagaatccaccacctcccgtagccaaccaggttctactcactcaacagtgtcacctgccagcaccaccacgccaggcctcagtgaggaatctaccaccgtctacagcagcagccgaggctcaactgaaaccacagtgttccctcacagcaccacaacctcagttcatggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacctggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcattccctgacagcaccaccacctcagacctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacattgtcccctggcagtaccacagcatcatcccttggtccagaatctactactttccacagcagcccaggctccactgaaacaacactcttacctgacaacaccacagcctcaggcctccttgaagcatctacgcccgtccacagcagcactggatcgccacacacaacactgtcccctgccggctctacaacacgtcagggagaatctaccaccttccagagctggccaagctcaaaggacactatgcctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacgctcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcacccccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccaccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcgttccctgacagcaccaccacctcaggcctcagtcaggaacctacagcttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggcctaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggctccagtcaggaatcaacaacttcccacagcagctcaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtcgtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcactggccttcaggaagaatctaccactttccagagctggccaagctcaagtgacacaacaccttcacctcccagcaccacagcagtccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactttcacctgccagcacgacaagctcaggcgtcagtgaagaatccaccacctcccacagccgaccaggctcaatgcacacaacagcattccctagcagtaccaccatgccaggcgtcagtcaggaatctacagcttcccacagcagcccaggctccacagacacaacactgtcccctggcagtaccacagcatcatcccttggtccagaatctactaccttccacagcagcccaggctccactgaaacaacactcttacctgacaacaccacagcctcaggcctccttgaagcatctacacccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaacattgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcaacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaattgcaacaacacactttcctgagagctccacaacctccggccgtagtgaggaatcaacagcatcccacagcagcccagatacaaatggaatcacacccttacctgcccattttactacctcaggccgcattgcagaatctaccaccttctatatctctccaggctcaatggaaacaacattagccagcactgccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcactgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctca

SEQ ID NO: 155574 - DNA, 16321 bp, Homo sapiens
  Payload ID: 10587
  Gene Symbol: MUC12
  Gene Name: mucin 12, cell surface associated
  Uniprot ID: Q9UKN1
  ENST ID: ENST00000536621
  CDS Start-End: 1-16008
atgctggtgatctggattctgacgctggctctccggctctgcgcgtccgttactacagtgacaccaggctcaacagtaaacaccagtattggaggtaatacaacttctgcatccacacccagttcaagcgacccttttaccacctttagtgactatggggtgtcagtcacatttatcacgggctcaactgcaacaaaacacttccttgacagctccacaaactcaggccacagtgaggaatcaacagtatcccacagcggcccaggtgcaactggaacaacactcttcccttcccactctgcaacctcagtttttgttggagaacctaaaacctcacccatcacttcagcctcaatggaaacaacagcgttacctggcagtaccacaacagcaggcctgagtgagaaatctaccaccttctacagtagccccagatcaccagacagaacactctcacctgcccgcacgacaagctcaggcgtcagtgaaaaatcaaccacctcccacagccgaccaggcccaacgcacacaatagcgttccctgacagtaccaccatgccaggcgtcagtcaggaatctacagcttcccacagcatccccggctccacagacacaacactgtcccctggcactaccacaccatcatcccttggtccagaatctactaccttccacagcagcccaggctacactaaaacaacacgcttacctgacaacaccacaacctcaggcctccttgaagcatctacgcccgtccacagcagcactggatcgccacacacaacactgtccccttccagctctacaacccatgagggagaacctaccaccttccagagctggccaagctcaaaggacacttcgcctgcaccttctggtaccacatcagcctttgttaaactatctacaacttatcacagcagcccgagctcaactccaacaacccacttttctgccagctccacaaccttgggccatagtgaggaatcgacaccagtccacagcagcccagttgcaactgcaacaacacccccacctgcccgctccgcgacctcaggccatgttgaagaatctacagcctaccacaggagcccgggctcaactcaaacaatgcacttccctgaaagctccacaacttcaggccatagtgaagaatcagcaactttccacggcagcacaacacacacaaaatcttcaactcctagcaccacagctgccctagcacatacaagctaccacagcagcctgggctcaactgaaacaacacacttccgtgatagctccacaatctcaggccgtagtgaggaatcaaaagcatcccacagcagcccagatgcaatggcaacaacagtcttacctgccggctctacaccctcagttcttgttggagactcgacgccctcacccatcagttcaggctcaatggaaaccacagcgttacccggcagtaccacaaaaccaggcctcagtgagaaatctaccactttctacagtagccccagatcaccagacacaacacacttacctgccagcatgacaagctcaggcgtcagtgaagaatccaccacctcccacagccgaccaggctcaacacacacaacagcattccctggcagtaccaccatgccaggcctcagtcaggaatctacagcttcccacagcagcccaggccccacagacacaacattgtcccctggcagtaccacagcatcatcccttggtccagaatatactaccttccacagccgcccaggctccactgaaacaacactcttacctgacaacaccacagcctcaggactccttgaagcatctatgcccgtccacagcagcaccagatcgccacacacaacactgtcccctgccggctctacaacccgtcagggagaatctaccacattccatagctggccaagctcaaaggacactaggcctgcacctcctactaccacatcagcctttgttgagccatctacaacctcccacggcagcccgagctcaattccaacaacccacatttctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcgcacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagagatctaccactttccatagtagccccagatcaccagccacaacactctcacctgccagcacgacaagctcaggcgtcagtgaagaatccaccacctcccgcagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagctcaggttcaactgacacagcactgtcccctggcagtaccacagccttatcctttggtcaagaatctacaaccttccacagcaacccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctactgccttccagacccacccagcctcaactcacacaacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctgggcgtcggtgaagaatccaccacctcccgtagccaaccaggttctactcactcaacagtgtcacctgccagcaccaccacgccaggcctcagtgaggaatctaccaccgtctacagcagcagccgaggctcaactgaaaccacagtgttccctcacagcaccacaacctcagttcatggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacctggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcattccctgacagcaccaccacctcagacctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacattgtcccctggcagtaccacagcatcatcccttggtccagaatctactactttccacagcagcccaggctccactgaaacaacactcttacctgacaacaccacagcctcaggcctccttgaagcatctacgcccgtccacagcagcactggatcgccacacacaacactgtcccctgccggctctacaacacgtcagggagaatctaccaccttccagagctggccaagctcaaaggacactatgcctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacgctcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcacccccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccaccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcgttccctgacagcaccaccacctcaggcctcagtcaggaacctacagcttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggcctaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggctccagtcaggaatcaacaacttcccacagcagctcaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtcgtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcactggccttcaggaagaatctaccactttccagagctggccaagctcaagtgacacaacaccttcacctcccagcaccacagcagtccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactttcacctgccagcacgacaagctcaggcgtcagtgaagaatccaccacctcccacagccgaccaggctcaatgcacacaacagcattccctagcagtaccaccatgccaggcgtcagtcaggaatctacagcttcccacagcagcccaggctccacagacacaacactgtcccctggcagtaccacagcatcatcccttggtccagaatctactaccttccacagcagcccaggctccactgaaacaacactcttacctgacaacaccacagcctcaggcctccttgaagcatctacacccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaacattgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcaacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcgtaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaattgcaacaacacactttcctgagagctccacaacctccggccgtagtgaggaatcaacagcatcccacagcagcccagatacaaatggaatcacacccttacctgcccattttactacctcaggccgcattgcagaatctaccaccttctatatctctccaggctcaatggaaacaacattagccagcactgccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcactgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcagaatgagaagtga

SEQ ID NO: 155575 - DNA, 587 bp, Homo sapiens
  Payload ID: 10588
  Gene Symbol: MUC13
  Gene Name: mucin 13, cell surface associated
  ENST ID: ENST00000478191
  CDS Start-End: 36-587
tttcctcctcagattaccaagcaagaacagctaaaatgaaagccatcattcatcttactcttcttgctctcctttctgtaaacacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagc

SEQ ID NO: 155576 - DNA, 2879 bp, Homo sapiens
  Payload ID: 10588
  Gene Symbol: MUC13
  Gene Name: mucin 13, cell surface associated
  Uniprot ID: Q9H3R2
  ENST ID: ENST00000616727
  CDS Start-End: 40-1578
atcatttcctcctcagattaccaagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtg

SEQ ID NO: 155577 - DNA, 2968 bp, Homo sapiens
  Payload ID: 10589
  Gene Symbol: MUC15
  Gene Name: mucin 15, cell surface associated
  ENST ID: ENST00000281268
  CDS Start-End: 1-936
atgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattt

SEQ ID NO: 155578 - DNA, 3156 bp, Homo sapiens
  Payload ID: 10589
  Gene Symbol: MUC15
  Gene Name: mucin 15, cell surface associated
  Uniprot ID: Q8N387
  ENST ID: ENST00000455601
  CDS Start-End: 120-1124
tctaatgcacgacagattcctttcagacaggacaactgtgatatttcagttcctgattgtaaatacctcctaagcctgaagattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattt

SEQ ID NO: 155579 - DNA, 3118 bp, Homo sapiens
  Payload ID: 10589
  Gene Symbol: MUC15
  Gene Name: mucin 15, cell surface associated
  ENST ID: ENST00000436318
  CDS Start-End: 1-1086
atgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattt

SEQ ID NO: 155580 - DNA, 1386 bp, Homo sapiens
  Payload ID: 10589
  Gene Symbol: MUC15
  Gene Name: mucin 15, cell surface associated
  ENST ID: ENST00000527569
  CDS Start-End: 148-1083
acacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccc

SEQ ID NO: 155581 - DNA, 2084 bp, Homo sapiens
  Payload ID: 10589
  Gene Symbol: MUC15
  Gene Name: mucin 15, cell surface associated
  ENST ID: ENST00000529533
  CDS Start-End: 239-1324
ggttcctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggt

SEQ ID NO: 155582 - DNA, 32767 bp, Homo sapiens
  Payload ID: 10590
  Gene Symbol: MUC16
  Gene Name: mucin 16, cell surface associated
  ENST ID: ENST00000397910
  CDS Start-End: 205-43728
aagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggagcagtccagcaggcacatccccaggaagcccagaaatgtctaccactctcaaaatcatgagctccaaggaacccagcatcagcccagagatcaggtccactgtgagaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaggaccctgaatacgctggacataaacttggaatctgggacgacttcatccccaagttggaaaagcagcccatatgagagaattgccccttctgagtccaccacagacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccctggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccattggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagcggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggacacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcaaccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccatcactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaatacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctctctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgacca

SEQ ID NO: 155583 - DNA, 4078 bp, Homo sapiens
  Payload ID: 10590
  Gene Symbol: MUC16
  Gene Name: mucin 16, cell surface associated
  ENST ID: ENST00000601404
  CDS Start-End: 1-3674
ccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcgtcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcggtgagaagggggtgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcgg

SEQ ID NO: 155584 - DNA, 4079 bp, Homo sapiens
  Payload ID: 10590
  Gene Symbol: MUC16
  Gene Name: mucin 16, cell surface associated
  ENST ID: ENST00000599436
  CDS Start-End: 1-3992
ccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcgtcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaaccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcgg

SEQ ID NO: 155585 - DNA, 2888 bp, Homo sapiens
  Payload ID: 10590
  Gene Symbol: MUC16
  Gene Name: mucin 16, cell surface associated
  ENST ID: ENST00000596768
  CDS Start-End: 1-2011
gcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcgg

SEQ ID NO: 155586 - DNA, 14247 bp, Homo sapiens
  Payload ID: 10591
  Gene Symbol: MUC17
  Gene Name: mucin 17, cell surface associated
  Uniprot ID: Q685J3
  ENST ID: ENST00000306151
  CDS Start-End: 65-13546
tctgaggctcatttcgccagctcctctgggggtgacaggcaagtgagacgtgctcagagctccgatgccaaggccagggaccatggcgctgtgtctgctgaccttggtcctctcgctcttgcccccacaagctgctgcagaacaggacctcagtgtgaacagggctgtgtgggatggaggagggtgcatctcccaaggggacgtcttgaaccgtcagtgccagcagctgtctcagcacgttaggacaggttctgcggcaaacaccgccacaggtacaacatctacaaatgtcgtggagccaagaatgtatttgagttgcagcaccaaccctgagatgacctcgattgagtccagtgtgacttcagacactcctggtgtctccagtaccaggatgacaccaacagaatccagaacaacttcagaatctaccagtgacagcaccacacttttccccagttctactgaagacacttcatctcctacaactcctgaaggcaccgacgtgcccatgtcaacaccaagtgaagaaagcatttcatcaacaatggcttttgtcagcactgcacctcttcccagttttgaggcctacacatctttaacatataaggttgatatgagcacacctctgaccacttctactcaggcaagttcatctcctactactcctgaaagcaccaccatacccaaatcaactaacagtgaaggaagcactccattaacaagtatgcctgccagcaccatgaaggtggccagttcagaggctatcacccttttgacaactcctgttgaaatcagcacacctgtgaccatttctgctcaagccagttcatctcctacaactgctgaaggtcccagcctgtcaaactcagctcctagtggaggaagcactccattaacaagaatgcctctcagcgtgatgctggtggtcagttctgaggctagcaccctttcaacaactcctgctgccaccaacattcctgtgatcacttctactgaagccagttcatctcctacaacggctgaaggcaccagcataccaacctcaacttatactgaaggaagcactccattaacaagtacgcctgccagcaccatgccggttgccacttctgaaatgagcacactttcaataactcctgttgacaccagcacacttgtgaccacttctactgaacccagttcacttcctacaactgctgaagctaccagcatgctaacctcaactcttagtgaaggaagcactccattaacaaatatgcctgtcagcaccatattggtggccagttctgaggctagcaccacttcaacaattcctgttgactccaaaacttttgtgaccactgctagtgaagccagctcatctcccacaactgctgaagataccagcattgcaacctcaactcctagtgaaggaagcactccattaacaagtatgcctgtcagcaccactccagtggccagttctgaggctagcaacctttcaacaactcctgttgactccaaaactcaggtgaccacttctactgaagccagttcatctcctccaactgctgaagttaacagcatgccaacctcaactcctagtgaaggaagcactccattaacaagtatgtctgtcagcaccatgccggtggccagttctgaggctagcaccctttcaacaactcctgttgacaccagcacacctgtgaccacttctagtgaagccagttcatcttctacaactcctgaaggtaccagcataccaacctcaactcctagtgaaggaagcactccattaacaaacatgcctgtcagcaccaggctggtggtcagttctgaggctagcaccacttcaacaactcctgctgactccaacacttttgtgaccacttctagtgaagctagttcatcttctacaactgctgaaggtaccagcatgccaacctcaacttacagtgaaagaggcactacaataacaagtatgtctgtcagcaccacactggtggccagttctgaggctagcaccctttcaacaactcctgttgactccaacactcctgtgaccacttcaactgaagccacttcatcttctacaactgcggaaggtaccagcatgccaacctcaacttatactgaaggaagcactccattaacaagtatgcctgtcaacaccacactggtggccagttctgaggctagcaccctttcaacaactcctgttgacaccagcacacctgtgaccacttcaactgaagccagttcctctcctacaactgctgatggtgccagtatgccaacctcaactcctagtgaaggaagcactccattaacaagtatgcctgtcagcaaaacgctgttgaccagttctgaggctagcaccctttcaacaactcctcttgacacaagcacacatatcaccacttctactgaagccagttgctctcctacaaccactgaaggtaccagcatgccaatctcaactcctagtgaaggaagtcctttattaacaagtatacctgtcagcatcacaccggtgaccagtcctgaggctagcaccctttcaacaactcctgttgactccaacagtcctgtgaccacttctactgaagtcagttcatctcctacacctgctgaaggtaccagcatgccaacctcaacttatagtgaaggaagaactcctttaacaagtatgcctgtcagcaccacactggtggccacttctgcaatcagcaccctttcaacaactcctgttgacaccagcacacctgtgaccaattctactgaagcccgttcgtctcctacaacttctgaaggtaccagcatgccaacctcaactcctggggaaggaagcactccattaacaagtatgcctgacagcaccacgccggtagtcagttctgaggctagaacactttcagcaactcctgttgacaccagcacacctgtgaccacttctactgaagccacttcatctcctacaactgctgaaggtaccagcataccaacctcgactcctagtgaaggaacgactccattaacaagcacacctgtcagccacacgctggtggccaattctgaggctagcaccctttcaacaactcctgttgactccaacactcctttgaccacttctactgaagccagttcacctcctcccactgctgaaggtaccagcatgccaacctcaactcctagtgaaggaagcactccattaacacgtatgcctgtcagcaccacaatggtggccagttctgaaacgagcacactttcaacaactcctgctgacaccagcacacctgtgaccacttattctcaagccagttcatcttctacaactgctgacggtaccagcatgccaacctcaacttatagtgaaggaagcactccactaacaagtgtgcctgtcagcaccaggctggtggtcagttctgaggctagcaccctttccacaactcctgtcgacaccagcatacctgtcaccacttctactgaagccagttcatctcctacaactgctgaaggtaccagcataccaacctcacctcccagtgaaggaaccactccgttagcaagtatgcctgtcagcaccacgctggtggtcagttctgaggctaacaccctttcaacaactcctgtggactccaaaactcaggtggccacttctactgaagccagttcacctcctccaactgctgaagttaccagcatgccaacctcaactcctggagaaagaagcactccattaacaagtatgcctgtcagacacacgccagtggccagttctgaggctagcaccctttcaacatctcccgttgacaccagcacacctgtgaccacttctgctgaaaccagttcctctcctacaaccgctgaaggtaccagcttgccaacctcaactactagtgaaggaagtactctattaacaagtatacctgtcagcaccacgctggtgaccagtcctgaggctagcacccttttaacaactcctgttgacactaaaggtcctgtggtcacttctaatgaagtcagttcatctcctacacctgctgaaggtaccagcatgccaacctcaacttatagtgaaggaagaactcctttaacaagtatacctgtcaacaccacactggtggccagttctgcaatcagcatcctttcaacaactcctgttgacaacagcacacctgtgaccacttctactgaagcctgttcatctcctacaacttctgaaggtaccagcatgccaaactcaaatcctagtgaaggaaccactccgttaacaagtatacctgtcagcaccacgccggtagtcagttctgaggctagcaccctttcagcaactcctgttgacaccagcacccctgggaccacttctgctgaagccacttcatctcctacaactgctgaaggtatcagcataccaacctcaactcctagtgaaggaaagactccattaaaaagtatacctgtcagcaacacgccggtggccaattctgaggctagcaccctttcaacaactcctgttgactctaacagtcctgtggtcacttctacagcagtcagttcatctcctacacctgctgaaggtaccagcatagcaatctcaacgcctagtgaaggaagcactgcattaacaagtatacctgtcagcaccacaacagtggccagttctgaaatcaacagcctttcaacaactcctgctgtcaccagcacacctgtgaccacttattctcaagccagttcatctcctacaactgctgacggtaccagcatgcaaacctcaacttatagtgaaggaagcactccactaacaagtttgcctgtcagcaccatgctggtggtcagttctgaggctaacaccctttcaacaacccctattgactccaaaactcaggtgaccgcttctactgaagccagttcatctacaaccgctgaaggtagcagcatgacaatctcaactcctagtgaaggaagtcctctattaacaagtatacctgtcagcaccacgccggtggccagtcctgaggctagcaccctttcaacaactcctgttgactccaacagtcctgtgatcacttctactgaagtcagttcatctcctacacctgctgaaggtaccagcatgccaacctcaacttatactgaaggaagaactcctttaacaagtataactgtcagaacaacaccggtggccagctctgcaatcagcaccctttcaacaactcccgttgacaacagcacacctgtgaccacttctactgaagcccgttcatctcctacaacttctgaaggtaccagcatgccaaactcaactcctagtgaaggaaccactccattaacaagtatacctgtcagcaccacgccggtactcagttctgaggctagcaccctttcagcaactcctattgacaccagcacccctgtgaccacttctactgaagccacttcgtctcctacaactgctgaaggtaccagcataccaacctcgactcttagtgaaggaatgactccattaacaagcacacctgtcagccacacgctggtggccaattctgaggctagcaccctttcaacaactcctgttgactctaacagtcctgtggtcacttctacagcagtcagttcatctcctacacctgctgaaggtaccagcatagcaacctcaacgcctagtgaaggaagcactgcattaacaagtatacctgtcagcaccacaacagtggccagttctgaaaccaacaccctttcaacaactcccgctgtcaccagcacacctgtgaccacttatgctcaagtcagttcatctcctacaactgctgacggtagcagcatgccaacctcaactcctagggaaggaaggcctccattaacaagtatacctgtcagcaccacaacagtggccagttctgaaatcaacaccctttcaacaactcttgctgacaccaggacacctgtgaccacttattctcaagccagttcatctcctacaactgctgatggtaccagcatgccaaccccagcttatagtgaaggaagcactccactaacaagtatgcctctcagcaccacgctggtggtcagttctgaggctagcactctttccacaactcctgttgacaccagcactcctgccaccacttctactgaaggcagttcatctcctacaactgcaggaggtaccagcatacaaacctcaactcctagtgaacggaccactccattagcaggtatgcctgtcagcactacgcttgtggtcagttctgagggtaacaccctttcaacaactcctgttgactccaaaactcaggtgaccaattctactgaagccagttcatctgcaaccgctgaaggtagcagcatgacaatctcagctcctagtgaaggaagtcctctactaacaagtatacctctcagcaccacgccggtggccagtcctgaggctagcaccctttcaacaactcctgttgactccaacagtcctgtgatcacttctactgaagtcagttcatctcctatacctactgaaggtaccagcatgcaaacctcaacttatagtgacagaagaactcctttaacaagtatgcctgtcagcaccacagtggtggccagttctgcaatcagcaccctttcaacaactcctgttgacaccagcacacctgtgaccaattctactgaagcccgttcatctcctacaacttctgaaggtaccagcatgccaacctcaactcctagtgaaggaagcactccattcacaagtatgcctgtcagcaccatgccggtagttacttctgaggctagcaccctttcagcaactcctgttgacaccagcacacctgtgaccacttctactgaagccacttcatctcctacaactgctgaaggtaccagcataccaacttcaactcttagtgaaggaacgactccattaacaagtatacctgtcagccacacgctggtggccaattctgaggttagcaccctttcaacaactcctgttgactccaacactcctttcactacttctactgaagccagttcacctcctcccactgctgaaggtaccagcatgccaacctcaacttctagtgaaggaaacactccattaacacgtatgcctgtcagcaccacaatggtggccagttttgaaacaagcacactttctacaactcctgctgacaccagcacacctgtgactacttattctcaagccggttcatctcctacaactgctgacgatactagcatgccaacctcaacttatagtgaaggaagcactccactaacaagtgtgcctgtcagcaccatgccggtggtcagttctgaggctagcacccattccacaactcctgttgacaccagcacacctgtcaccacttctactgaagccagttcatctcctacaactgctgaaggtaccagcataccaacctcacctcctagtgaaggaaccactccgttagcaagtatgcctgtcagcaccacgccggtggtcagttctgaggctggcaccctttccacaactcctgttgacaccagcacacctatgaccacttctactgaagccagttcatctcctacaactgctgaagatatcgtcgtgccaatctcaactgctagtgaaggaagtactctattaacaagtatacctgtcagcaccacgccagtggccagtcctgaggctagcaccctttcaacaactcctgttgactccaacagtcctgtggtcacttctactgaaatcagttcatctgctacatccgctgaaggtaccagcatgcctacctcaacttatagtgaaggaagcactccattaagaagtatgcctgtcagcaccaagccgttggccagttctgaggctagcactctttcaacaactcctgttgacaccagcatacctgtcaccacttctactgaaaccagttcatctcctacaactgcaaaagataccagcatgccaatctcaactcctagtgaagtaagtacttcattaacaagtatacttgtcagcaccatgccagtggccagttctgaggctagcaccctttcaacaactcctgttgacaccaggacacttgtgaccacttccactggaaccagttcatctcctacaactgctgaaggtagcagcatgccaacctcaactcctggtgaaagaagcactccattaacaaatatacttgtcagcaccacgctgttggccaattctgaggctagcaccctttcaacaactcctgttgacaccagcacacctgtcaccacttctgctgaagccagttcttctcctacaactgctgaaggtaccagcatgcgaatctcaactcctagtgatggaagtactccattaacaagtatacttgtcagcaccctgccagtggccagttctgaggctagcaccgtttcaacaactgctgttgacaccagcatacctgtcaccacttctactgaagccagttcctctcctacaactgctgaagttaccagcatgccaacctcaactcctagtgaaacaagtactccattaactagtatgcctgtcaaccacacgccagtggccagttctgaggctggcaccctttcaacaactcctgttgacaccagcacacctgtgaccacttctactaaagccagttcatctcctacaactgctgaaggtatcgtcgtgccaatctcaactgctagtgaaggaagtactctattaacaagtatacctgtcagcaccacgccggtggccagttctgaggctagcaccctttcaacaactcctgttgataccagcatacctgtcaccacttctactgaaggcagttcttctcctacaactgctgaaggtaccagcatgccaatctcaactcctagtgaagtaagtactccattaacaagtatacttgtcagcaccgtgccagtggccggttctgaggctagcaccctttcaacaactcctgttgacaccaggacacctgtcaccacttctgctgaagctagttcttctcctacaactgctgaaggtaccagcatgccaatctcaactcctggcgaaagaagaactccattaacaagtatgtctgtcagcaccatgccggtggccagttctgaggctagcaccctttcaagaactcctgctgacaccagcacacctgtgaccacttctactgaagccagttcctctcctacaactgctgaaggtaccggcataccaatctcaactcctagtgaaggaagtactccattaacaagtatacctgtcagcaccacgccagtggccattcctgaggctagcaccctttcaacaactcctgttgactccaacagtcctgtggtcacttctactgaagtcagttcatctcctacacctgctgaaggtaccagcatgccaatctcaacttatagtgaaggaagcactccattaacaggtgtgcctgtcagcaccacaccggtgaccagttctgcaatcagcaccctttcaacaactcctgttgacaccagcacacctgtgaccacttctactgaagcccattcatctcctacaacttctgaaggtaccagcatgccaacctcaactcctagtgaaggaagtactccattaacatatatgcctgtcagcaccatgctggtagtcagttctgaggatagcaccctttcagcaactcctgttgacaccagcacacctgtgaccacttctactgaagccacttcatctacaactgctgaaggtaccagcattccaacctcaactcctagtgaaggaatgactccattaactagtgtacctgtcagcaacacgccggtggccagttctgaggctagcatcctttcaacaactcctgttgactccaacactcctttgaccacttctactgaagccagttcatctcctcccactgctgaaggtaccagcatgccaacctcaactcctagtgaaggaagcactccattaacaagtatgcctgtcagcaccacaacggtggccagttctgaaacgagcaccctttcaacaactcctgctgacaccagcacacctgtgaccacttattctcaagccagttcatctcctccaattgctgacggtactagcatgccaacctcaacttatagtgaaggaagcactccactaacaaatatgtctttcagcaccacgccagtggtcagttctgaggctagcaccctttccacaactcctgttgacaccagcacacctgtcaccacttctactgaagccagtttatctcctacaactgctgaaggtaccagcataccaacctcaagtcctagtgaaggaaccactccattagcaagtatgcctgtcagcaccacgccggtggtcagttctgaggttaacaccctttcaacaactcctgtggactccaacactctggtgaccacttctactgaagccagttcatctcctacaatcgctgaaggtaccagcttgccaacctcaactactagtgaaggaagcactccattatcaattatgcctctcagtaccacgccggtggccagttctgaggctagcaccctttcaacaactcctgttgacaccagcacacctgtgaccacttcttctccaaccaattcatctcctacaactgctgaagttaccagcatgccaacatcaactgctggtgaaggaagcactccattaacaaatatgcctgtcagcaccacaccggtggccagttctgaggctagcaccctttcaacaactcctgttgactccaacacttttgttaccagttctagtcaagccagttcatctccagcaactcttcaggtcaccactatgcgtatgtctactccaagtgaaggaagctcttcattaacaactatgctcctcagcagcacatatgtgaccagttctgaggctagcacaccttccactccttctgttgacagaagcacacctgtgaccacttctactcagagcaattctactcctacacctcctgaagttatcaccctgccaatgtcaactcctagtgaagtaagcactccattaaccattatgcctgtcagcaccacatcggtgaccatttctgaggctggcacagcttcaacacttcctgttgacaccagcacacctgtgatcacttctacccaagtcagttcatctcctgtgactcctgaaggtaccaccatgccaatctggacgcctagtgaaggaagcactccattaacaactatgcctgtcagcaccacacgtgtgaccagctctgagggtagcaccctttcaacaccttctgttgtcaccagcacacctgtgaccacttctactgaagccatttcatcttctgcaactcttgacagcaccaccatgtctgtgtcaatgcccatggaaataagcacccttgggaccactattcttgtcagtaccacacctgttacgaggtttcctgagagtagcaccccttccataccatctgtttacaccagcatgtctatgaccactgcctctgaaggcagttcatctcctacaactcttgaaggcaccaccaccatgcctatgtcaactacgagtgaaagaagcactttattgacaactgtcctcatcagccctatatctgtgatgagtccttctgaggccagcacactttcaacacctcctggtgataccagcacacctttgctcacctctaccaaagccggttcattctccatacctgctgaagtcactaccatacgtatttcaattaccagtgaaagaagcactccattaacaactctccttgtcagcaccacacttccaactagctttcctggggccagcatagcttcgacacctcctcttgacacaagcacaacttttaccccttctactgacactgcctcaactcccacaattcctgtagccaccaccatatctgtatcagtgatcacagaaggaagcacacctgggacaaccatttttattcccagcactcctgtcaccagttctactgctgatgtctttcctgcaacaactggtgctgtatctacccctgtgataacttccactgaactaaacacaccatcaacctccagtagtagtaccaccacatctttttcaactactaaggaatttacaacacccgcaatgactactgcagctcccctcacatatgtgaccatgtctactgcccccagcacacccagaacaaccagcagaggctgcactacttctgcatcaacgctttctgcaaccagtacacctcacacctctacttctgtcaccacccgtcctgtgaccccttcatcagaatccagcaggccgtcaacaattacttctcacaccatcccacctacatttcctcctgctcactccagtacacctccaacaacctctgcctcctccacgactgtgaaccctgaggctgtcaccaccatgaccaccaggacaaaacccagcacacggaccacttccttccccacggtgaccaccaccgctgtccccacgaatactacaattaagagcaaccccacctcaactcctactgtgccaagaaccacaacatgctttggagatgggtgccagaatacggcctctcgctgcaagaatggaggcacctgggatgggctcaagtgccagtgtcccaacctctattatggggagttgtgtgaggaggtggtcagcagcattgacatagggccaccggagactatctctgcccaaatggaactgactgtgacagtgaccagtgtgaagttcaccgaagagctaaaaaaccactcttcccaggaattccaggagttcaaacagacattcacggaacagatgaatattgtgtattccgggatccctgagtatgtcggggtgaacatcacaaagctacgtcttggcagtgtggtggtggagcatgacgtcctcctaagaaccaagtacacaccagaatacaagacagtattggacaatgccaccgaagtagtgaaagagaaaatcacaaaagtgaccacacagcaaataatgattaatgatatttgctcagacatgatgtgtttcaacaccactggcacccaagtgcaaaacattacggtgacccagtacgaccctgaagaggactgccggaagatggccaaggaatatggagactacttcgtagtggagtaccgggaccagaagccatactgcatcagcccctgtgagcctggcttcagtgtctccaagaactgtaacctcggcaagtgccagatgtctctaagtggacctcagtgcctctgcgtgaccacggaaactcactggtacagtggggagacctgtaaccagggcacccagaagagtctggtgtacggcctcgtgggggcaggggtcgtgctgatgctgatcatcctggtagctctcctgatgctcgttttccgctccaagagagaggtgaaacggcaaaagtacagattgtctcagttatacaagtggcaagaagaggacagtggaccagctcctgggaccttccaaaacattggctttgacatctgccaagatgatgattccatccacctggagtccatctatagtaatttccagccctccttgagacacatagaccctgaaacaaagatccgaattcagaggcctcaggtaatgacgacatcattttaaggcatggagctgagaagtctgggagtgaggagatcccagtccggctaagcttggtggagcattttcccattgagagccttccatgggaactcaatgttcccattgtaagtacaggaaacaagccctgtacttaccaaggagaaagaggagagacagcagtgctgggagattctcaaatagaaacccgtggacgctccaatgggcttgtcatgatatcaggctaggctttcctgctcatttttcaaagacgctccagatttgagggtactctgactgcaacatctttcaccccattgatcgccaggattgatttggttgatctggctgagcaggcgggtgtccccgtcctccctcactgccccatatgtgtccctcctaaagctgcatgctcagttgaagaggacgagaggacgaccttctctgatagaggaggaccacgcttcagtcaaaggcatacaagtatctatctggacttccctgctagcacttccaaacaagctcagagatgttcctcccctcatctgcccgggttcagtaccatggacagcgccctcgacccgctgtttacaaccatgaccccttggacactggactgcatgcactttacatatcacaaaatgctctcataagaattattgcataccatcttcatgaaaaacacctgtatttaaatatagagcatttaccttttggtatataag

SEQ ID NO: 155587 - DNA, 14089 bp, Homo sapiens
  Payload ID: 10591
  Gene Symbol: MUC17
  Gene Name: mucin 17, cell surface associated
  ENST ID: ENST00000379439
  CDS Start-End: 65-12853
tctgaggctcatttcgccagctcctctgggggtgacaggcaagtgagacgtgctcagagctccgatgccaaggccagggaccatggcgctgtgtctgctgaccttggtcctctcgctcttgcccccacaagctgctgcagaacaggacctcagtgtgaacagggctgtgtgggatggaggagggtgcatctcccaaggggacgtcttgaaccgtcagtgccagcagctgtctcagcacgttaggacaggttctgcggcaaacaccgccacaggtacaacatctacaaatgtcgtggagccaagaatgtatttgagttgcagcaccaaccctgagatgacctcgattgagtccagtgtgacttcagacactcctggtgtctccagtaccaggatgacaccaacagaatccagaacaacttcagaatctaccagtgacagcaccacacttttccccagttctactgaagacacttcatctcctacaactcctgaaggcaccgacgtgcccatgtcaacaccaagtgaagaaagcatttcatcaacaatggcttttgtcagcactgcacctcttcccagttttgaggcctacacatctttaacatataaggttgatatgagcacacctctgaccacttctactcaggcaagttcatctcctactactcctgaaagcaccaccatacccaaatcaactaacagtgaaggaagcactccattaacaagtatgcctgccagcaccatgaaggtggccagttcagaggctatcacccttttgacaactcctgttgaaatcagcacacctgtgaccatttctgctcaagccagttcatctcctacaactgctgaaggtcccagcctgtcaaactcagctcctagtggaggaagcactccattaacaagaatgcctctcagcgtgatgctggtggtcagttctgaggctagcaccctttcaacaactcctgctgccaccaacattcctgtgatcacttctactgaagccagttcatctcctacaacggctgaaggcaccagcataccaacctcaacttatactgaaggaagcactccattaacaagtacgcctgccagcaccatgccggttgccacttctgaaatgagcacactttcaataactcctgttgacaccagcacacttgtgaccacttctactgaacccagttcacttcctacaactgctgaagctaccagcatgctaacctcaactcttagtgaaggaagcactccattaacaaatatgcctgtcagcaccatattggtggccagttctgaggctagcaccacttcaacaattcctgttgactccaaaacttttgtgaccactgctagtgaagccagctcatctcccacaactgctgaagataccagcattgcaacctcaactcctagtgaaggaagcactccattaacaagtatgcctgtcagcaccactccagtggccagttctgaggctagcaacctttcaacaactcctgttgactccaaaactcaggtgaccacttctactgaagccagttcatctcctccaactgctgaagttaacagcatgccaacctcaactcctagtgaaggaagcactccattaacaagtatgtctgtcagcaccatgccggtggccagttctgaggctagcaccctttcaacaactcctgttgacaccagcacacctgtgaccacttctagtgaagccagttcatcttctacaactcctgaaggtaccagcataccaacctcaactcctagtgaaggaagcactccattaacaaacatgcctgtcagcaccaggctggtggtcagttctgaggctagcaccacttcaacaactcctgctgactccaacacttttgtgaccacttctagtgaagctagttcatcttctacaactgctgaaggtaccagcatgccaacctcaacttacagtgaaagaggcactacaataacaagtatgtctgtcagcaccacactggtggccagttctgaggctagcaccctttcaacaactcctgttgactccaacactcctgtgaccacttcaactgaagccacttcatcttctacaactgcggaaggtaccagcatgccaacctcaacttatactgaaggaagcactccattaacaagtatgcctgtcaacaccacactggtggccagttctgaggctagcaccctttcaacaactcctgttgacaccagcacacctgtgaccacttcaactgaagccagttcctctcctacaactgctgatggtgccagtatgccaacctcaactcctagtgaaggaagcactccattaacaagtatgcctgtcagcaaaacgctgttgaccagttctgaggctagcaccctttcaacaactcctcttgacacaagcacacatatcaccacttctactgaagccagttgctctcctacaaccactgaaggtaccagcatgccaatctcaactcctagtgaaggaagtcctttattaacaagtatacctgtcagcatcacaccggtgaccagtcctgaggctagcaccctttcaacaactcctgttgactccaacagtcctgtgaccacttctactgaagtcagttcatctcctacacctgctgaaggtaccagcatgccaacctcaacttatagtgaaggaagaactcctttaacaagtatgcctgtcagcaccacactggtggccacttctgcaatcagcaccctttcaacaactcctgttgacaccagcacacctgtgaccaattctactgaagcccgttcgtctcctacaacttctgaaggtaccagcatgccaacctcaactcctggggaaggaagcactccattaacaagtatgcctgacagcaccacgccggtagtcagttctgaggctagaacactttcagcaactcctgttgacaccagcacacctgtgaccacttctactgaagccacttcatctcctacaactgctgaaggtaccagcataccaacctcgactcctagtgaaggaacgactccattaacaagcacacctgtcagccacacgctggtggccaattctgaggctagcaccctttcaacaactcctgttgactccaacactcctttgaccacttctactgaagccagttcacctcctcccactgctgaaggtaccagcatgccaacctcaactcctagtgaaggaagcactccattaacacgtatgcctgtcagcaccacaatggtggccagttctgaaacgagcacactttcaacaactcctgctgacaccagcacacctgtgaccacttattctcaagccagttcatcttctacaactgctgacggtaccagcatgccaacctcaacttatagtgaaggaagcactccactaacaagtgtgcctgtcagcaccaggctggtggtcagttctgaggctagcaccctttccacaactcctgtcgacaccagcatacctgtcaccacttctactgaagccagttcatctcctacaactgctgaaggtaccagcataccaacctcacctcccagtgaaggaaccactccgttagcaagtatgcctgtcagcaccacgctggtggtcagttctgaggctaacaccctttcaacaactcctgtggactccaaaactcaggtggccacttctactgaagccagttcacctcctccaactgctgaagttaccagcatgccaacctcaactcctggagaaagaagcactccattaacaagtatgcctgtcagacacacgccagtggccagttctgaggctagcaccctttcaacatctcccgttgacaccagcacacctgtgaccacttctgctgaaaccagttcctctcctacaaccgctgaaggtaccagcttgccaacctcaactactagtgaaggaagtactctattaacaagtatacctgtcagcaccacgctggtgaccagtcctgaggctagcacccttttaacaactcctgttgacactaaaggtcctgtggtcacttctaatgaagtcagttcatctcctacacctgctgaaggtaccagcatgccaacctcaacttatagtgaaggaagaactcctttaacaagtatacctgtcaacaccacactggtggccagttctgcaatcagcatcctttcaacaactcctgttgacaacagcacacctgtgaccacttctactgaagcctgttcatctcctacaacttctgaaggtaccagcatgccaaactcaaatcctagtgaaggaaccactccgttaacaagtatacctgtcagcaccacgccggtagtcagttctgaggctagcaccctttcagcaactcctgttgacaccagcacccctgggaccacttctgctgaagccacttcatctcctacaactgctgaaggtatcagcataccaacctcaactcctagtgaaggaaagactccattaaaaagtatacctgtcagcaacacgccggtggccaattctgaggctagcaccctttcaacaactcctgttgactctaacagtcctgtggtcacttctacagcagtcagttcatctcctacacctgctgaaggtaccagcatagcaatctcaacgcctagtgaaggaagcactgcattaacaagtatacctgtcagcaccacaacagtggccagttctgaaatcaacagcctttcaacaactcctgctgtcaccagcacacctgtgaccacttattctcaagccagttcatctcctacaactgctgacggtaccagcatgcaaacctcaacttatagtgaaggaagcactccactaacaagtttgcctgtcagcaccatgctggtggtcagttctgaggctaacaccctttcaacaacccctattgactccaaaactcaggtgaccgcttctactgaagccagttcatctacaaccgctgaaggtagcagcatgacaatctcaactcctagtgaaggaagtcctctattaacaagtatacctgtcagcaccacgccggtggccagtcctgaggctagcaccctttcaacaactcctgttgactccaacagtcctgtgatcacttctactgaagtcagttcatctcctacacctgctgaaggtaccagcatgccaacctcaacttatactgaaggaagaactcctttaacaagtataactgtcagaacaacaccggtggccagctctgcaatcagcaccctttcaacaactcccgttgacaacagcacacctgtgaccacttctactgaagcccgttcatctcctacaacttctgaaggtaccagcatgccaaactcaactcctagtgaaggaaccactccattaacaagtatacctgtcagcaccacgccggtactcagttctgaggctagcaccctttcagcaactcctattgacaccagcacccctgtgaccacttctactgaagccacttcgtctcctacaactgctgaaggtaccagcataccaacctcgactcttagtgaaggaatgactccattaacaagcacacctgtcagccacacgctggtggccaattctgaggctagcaccctttcaacaactcctgttgactctaacagtcctgtggtcacttctacagcagtcagttcatctcctacacctgctgaaggtaccagcatagcaacctcaacgcctagtgaaggaagcactgcattaacaagtatacctgtcagcaccacaacagtggccagttctgaaaccaacaccctttcaacaactcccgctgtcaccagcacacctgtgaccacttatgctcaagtcagttcatctcctacaactgctgacggtagcagcatgccaacctcaactcctagggaaggaaggcctccattaacaagtatacctgtcagcaccacaacagtggccagttctgaaatcaacaccctttcaacaactcttgctgacaccaggacacctgtgaccacttattctcaagccagttcatctcctacaactgctgatggtaccagcatgccaaccccagcttatagtgaaggaagcactccactaacaagtatgcctctcagcaccacgctggtggtcagttctgaggctagcactctttccacaactcctgttgacaccagcactcctgccaccacttctactgaaggcagttcatctcctacaactgcaggaggtaccagcatacaaacctcaactcctagtgaacggaccactccattagcaggtatgcctgtcagcactacgcttgtggtcagttctgagggtaacaccctttcaacaactcctgttgactccaaaactcaggtgaccaattctactgaagccagttcatctgcaaccgctgaaggtagcagcatgacaatctcagctcctagtgaaggaagtcctctactaacaagtatacctctcagcaccacgccggtggccagtcctgaggctagcaccctttcaacaactcctgttgactccaacagtcctgtgatcacttctactgaagtcagttcatctcctatacctactgaaggtaccagcatgcaaacctcaacttatagtgacagaagaactcctttaacaagtatgcctgtcagcaccacagtggtggccagttctgcaatcagcaccctttcaacaactcctgttgacaccagcacacctgtgaccaattctactgaagcccgttcatctcctacaacttctgaaggtaccagcatgccaacctcaactcctagtgaaggaagcactccattcacaagtatgcctgtcagcaccatgccggtagttacttctgaggctagcaccctttcagcaactcctgttgacaccagcacacctgtgaccacttctactgaagccacttcatctcctacaactgctgaaggtaccagcataccaacttcaactcttagtgaaggaacgactccattaacaagtatacctgtcagccacacgctggtggccaattctgaggttagcaccctttcaacaactcctgttgactccaacactcctttcactacttctactgaagccagttcacctcctcccactgctgaaggtaccagcatgccaacctcaacttctagtgaaggaaacactccattaacacgtatgcctgtcagcaccacaatggtggccagttttgaaacaagcacactttctacaactcctgctgacaccagcacacctgtgactacttattctcaagccggttcatctcctacaactgctgacgatactagcatgccaacctcaacttatagtgaaggaagcactccactaacaagtgtgcctgtcagcaccatgccggtggtcagttctgaggctagcacccattccacaactcctgttgacaccagcacacctgtcaccacttctactgaagccagttcatctcctacaactgctgaaggtaccagcataccaacctcacctcctagtgaaggaaccactccgttagcaagtatgcctgtcagcaccacgccggtggtcagttctgaggctggcaccctttccacaactcctgttgacaccagcacacctatgaccacttctactgaagccagttcatctcctacaactgctgaagatatcgtcgtgccaatctcaactgctagtgaaggaagtactctattaacaagtatacctgtcagcaccacgccagtggccagtcctgaggctagcaccctttcaacaactcctgttgactccaacagtcctgtggtcacttctactgaaatcagttcatctgctacatccgctgaaggtaccagcatgcctacctcaacttatagtgaaggaagcactccattaagaagtatgcctgtcagcaccaagccgttggccagttctgaggctagcactctttcaacaactcctgttgacaccagcatacctgtcaccacttctactgaaaccagttcatctcctacaactgcaaaagataccagcatgccaatctcaactcctagtgaagtaagtacttcattaacaagtatacttgtcagcaccatgccagtggccagttctgaggctagcaccctttcaacaactcctgttgacaccaggacacttgtgaccacttccactggaaccagttcatctcctacaactgctgaaggtagcagcatgccaacctcaactcctggtgaaagaagcactccattaacaaatatacttgtcagcaccacgctgttggccaattctgaggctagcaccctttcaacaactcctgttgacaccagcacacctgtcaccacttctgctgaagccagttcttctcctacaactgctgaaggtaccagcatgcgaatctcaactcctagtgatggaagtactccattaacaagtatacttgtcagcaccctgccagtggccagttctgaggctagcaccgtttcaacaactgctgttgacaccagcatacctgtcaccacttctactgaagccagttcctctcctacaactgctgaagttaccagcatgccaacctcaactcctagtgaaacaagtactccattaactagtatgcctgtcaaccacacgccagtggccagttctgaggctggcaccctttcaacaactcctgttgacaccagcacacctgtgaccacttctactaaagccagttcatctcctacaactgctgaaggtatcgtcgtgccaatctcaactgctagtgaaggaagtactctattaacaagtatacctgtcagcaccacgccggtggccagttctgaggctagcaccctttcaacaactcctgttgataccagcatacctgtcaccacttctactgaaggcagttcttctcctacaactgctgaaggtaccagcatgccaatctcaactcctagtgaagtaagtactccattaacaagtatacttgtcagcaccgtgccagtggccggttctgaggctagcaccctttcaacaactcctgttgacaccaggacacctgtcaccacttctgctgaagctagttcttctcctacaactgctgaaggtaccagcatgccaatctcaactcctggcgaaagaagaactccattaacaagtatgtctgtcagcaccatgccggtggccagttctgaggctagcaccctttcaagaactcctgctgacaccagcacacctgtgaccacttctactgaagccagttcctctcctacaactgctgaaggtaccggcataccaatctcaactcctagtgaaggaagtactccattaacaagtatacctgtcagcaccacgccagtggccattcctgaggctagcaccctttcaacaactcctgttgactccaacagtcctgtggtcacttctactgaagtcagttcatctcctacacctgctgaaggtaccagcatgccaatctcaacttatagtgaaggaagcactccattaacaggtgtgcctgtcagcaccacaccggtgaccagttctgcaatcagcaccctttcaacaactcctgttgacaccagcacacctgtgaccacttctactgaagcccattcatctcctacaacttctgaaggtaccagcatgccaacctcaactcctagtgaaggaagtactccattaacatatatgcctgtcagcaccatgctggtagtcagttctgaggatagcaccctttcagcaactcctgttgacaccagcacacctgtgaccacttctactgaagccacttcatctacaactgctgaaggtaccagcattccaacctcaactcctagtgaaggaatgactccattaactagtgtacctgtcagcaacacgccggtggccagttctgaggctagcatcctttcaacaactcctgttgactccaacactcctttgaccacttctactgaagccagttcatctcctcccactgctgaaggtaccagcatgccaacctcaactcctagtgaaggaagcactccattaacaagtatgcctgtcagcaccacaacggtggccagttctgaaacgagcaccctttcaacaactcctgctgacaccagcacacctgtgaccacttattctcaagccagttcatctcctccaattgctgacggtactagcatgccaacctcaacttatagtgaaggaagcactccactaacaaatatgtctttcagcaccacgccagtggtcagttctgaggctagcaccctttccacaactcctgttgacaccagcacacctgtcaccacttctactgaagccagtttatctcctacaactgctgaaggtaccagcataccaacctcaagtcctagtgaaggaaccactccattagcaagtatgcctgtcagcaccacgccggtggtcagttctgaggttaacaccctttcaacaactcctgtggactccaacactctggtgaccacttctactgaagccagttcatctcctacaatcgctgaaggtaccagcttgccaacctcaactactagtgaaggaagcactccattatcaattatgcctctcagtaccacgccggtggccagttctgaggctagcaccctttcaacaactcctgttgacaccagcacacctgtgaccacttcttctccaaccaattcatctcctacaactgctgaagttaccagcatgccaacatcaactgctggtgaaggaagcactccattaacaaatatgcctgtcagcaccacaccggtggccagttctgaggctagcaccctttcaacaactcctgttgactccaacacttttgttaccagttctagtcaagccagttcatctccagcaactcttcaggtcaccactatgcgtatgtctactccaagtgaaggaagctcttcattaacaactatgctcctcagcagcacatatgtgaccagttctgaggctagcacaccttccactccttctgttgacagaagcacacctgtgaccacttctactcagagcaattctactcctacacctcctgaagttatcaccctgccaatgtcaactcctagtgaagtaagcactccattaaccattatgcctgtcagcaccacatcggtgaccatttctgaggctggcacagcttcaacacttcctgttgacaccagcacacctgtgatcacttctacccaagtcagttcatctcctgtgactcctgaaggtaccaccatgccaatctggacgcctagtgaaggaagcactccattaacaactatgcctgtcagcaccacacgtgtgaccagctctgagggtagcaccctttcaacaccttctgttgtcaccagcacacctgtgaccacttctactgaagccatttcatcttctgcaactcttgacagcaccaccatgtctgtgtcaatgcccatggaaataagcacccttgggaccactattcttgtcagtaccacacctgttacgaggtttcctgagagtagcaccccttccataccatctgtttacaccagcatgtctatgaccactgcctctgaaggcagttcatctcctacaactcttgaaggcaccaccaccatgcctatgtcaactacgagtgaaagaagcactttattgacaactgtcctcatcagccctatatctgtgatgagtccttctgaggccagcacactttcaacacctcctggtgataccagcacacctttgctcacctctaccaaagccggttcattctccatacctgctgaagtcactaccatacgtatttcaattaccagtgaaagaagcactccattaacaactctccttgtcagcaccacacttccaactagctttcctggggccagcatagcttcgacacctcctcttgacacaagcacaacttttaccccttctactgacactgcctcaactcccacaattcctgtagccaccaccatatctgtatcagtgatcacagaaggaagcacacctgggacaaccatttttattcccagcactcctgtcaccagttctactgctgatgtctttcctgcaacaactggtgctgtatctacccctgtgataacttccactgaactaaacacaccatcaacctccagtagtagtaccaccacatctttttcaactactaaggaatttacaacacccgcaatgactactgcagctcccctcacatatgtgaccatgtctactgcccccagcacacccagaacaaccagcagaggctgcactacttctgcatcaacgctttctgcaaccagtacacctcacacctctacttctgtcaccacccgtcctgtgaccccttcatcagaatccagcaggccgtcaacaattacttctcacaccatcccacctacatttcctcctgctcactccagtacacctccaacaacctctgcctcctccacgactgtgaaccctgaggctgtcaccaccatgaccaccaggacaaaacccagcacacggaccacttccttccccacggtgaccaccaccgctgtccccacgaatactacaattaagagcaaccccacctcaactcctactgtgccaagaaccacaacatgctttggagatgggtgccagaatacggcctctcgctgcaagaatggaggcacctgggatgggctcaagtgccagtgtcccaacctctattatggggagttgtgtgaggaggtggtcagcagcattgacatagggccaccggagactatctctgcccaaatggaactgactgtgacagtgaccagtgtgaagttcaccgaagagctaaaaaaccactcttcccaggaattccaggagttcaaacagacattcacggaacagatgaatattgtgtattccgggatccctgagtatgtcggggtgaacatcacaaagctacgacatgatgtgtttcaacaccactggcacccaagtgcaaaacattacggtgacccagtacgaccctgaagaggactgccggaagatggccaaggaatatggagactacttcgtagtggagtaccgggaccagaagccatactgcatcagcccctgtgagcctggcttcagtgtctccaagaactgtaacctcggcaagtgccagatgtctctaagtggacctcagtgcctctgcgtgaccacggaaactcactggtacagtggggagacctgtaaccagggcacccagaagagtctggtgtacggcctcgtgggggcaggggtcgtgctgatgctgatcatcctggtagctctcctgatgctcgttttccgctccaagagagaggtgaaacggcaaaagtacagattgtctcagttatacaagtggcaagaagaggacagtggaccagctcctgggaccttccaaaacattggctttgacatctgccaagatgatgattccatccacctggagtccatctatagtaatttccagccctccttgagacacatagaccctgaaacaaagatccgaattcagaggcctcaggtaatgacgacatcattttaaggcatggagctgagaagtctgggagtgaggagatcccagtccggctaagcttggtggagcattttcccattgagagccttccatgggaactcaatgttcccattgtaagtacaggaaacaagccctgtacttaccaaggagaaagaggagagacagcagtgctgggagattctcaaatagaaacccgtggacgctccaatgggcttgtcatgatatcaggctaggctttcctgctcatttttcaaagacgctccagatttgagggtactctgactgcaacatctttcaccccattgatcgccaggattgatttggttgatctggctgagcaggcgggtgtccccgtcctccctcactgccccatatgtgtccctcctaaagctgcatgctcagttgaagaggacgagaggacgaccttctctgatagaggaggaccacgcttcagtcaaaggcatacaagtatctatctggacttccctgctagcacttccaaacaagctcagagatgttcctcccctcatctgcccgggttcagtaccatggacagcgccctcgacccgctgtttacaaccatgaccccttggacactggactgcatgcactttacatatcacaaaatgctctcataagaattattgcataccatcttcatgaaaaacacctgtatttaaatatagagcatttaccttttggta

SEQ ID NO: 155588 - DNA, 5337 bp, Homo sapiens
  Payload ID: 10592
  Gene Symbol: MUC2
  Gene Name: mucin 2, oligomeric mucus/gel-forming
  ENST ID: ENST00000622511
  CDS Start-End: 1-5337
atggggctgccactagcccgcctggcggctgtgtgcctggccctgtctttggcagggggctcggagctccagacagagggcagaacccgaaaccacggccacaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggaaggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccaccaccttcaccactaccaccaccaccaccaccccgacctccagcacagttttatcaacaactccgaagctgtgctgcctctggtctgactggatcaatgaggaccaccccagcagtggcagcgacgacggtgaccgagaaacatttgatggggtctgcggggcccctgaggacatcgagtgcaggtcggtcaaggatccccacctcagcttggagcagctaggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccagcacgaccacccttccaccaaccaccacccccagccctccaaccaccaccacaaccacccctccaccaaccaccacccccagccctccaataaccaccacgaccacccctccaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaacgactacgcccatcactccaccagccagcactaccacccttccaccaaccaccactcccagccctccaacaaccaccacaaccacccctccaccaaccaccactcccatcaccaccaccaccacggtgaccccaaccccaacacccaccggcacacagaccccaacaacgacacccatcaccaccaccaccacggtgaccccaaccccaacacccaccggcacacagaccccaacatcgacacccatcaccaccaccactacgaccccaaccccaacagccatcaccaccaccactacggtgaccccaaccccaacacccaccggcacacagaccccaaccacgacacccatcaccaccaccactacggtgacaccaaccccaacacccaccggcacacagtccccaaccccaacagccatcaccaccaccactacggtgaccccaaccccaacacccaccggcacacagaccccaacatcgacacccatcaccaccaccactacggtgaccccaaccccaacacccaccggcacacagaccccaaccccgacacccatctccaccaccactacggtgaccccaaccccaacacccaccggcacacagaccccaaccacgacacccatcaccaccaccaccacggtgaccccaaccccgacacccaccggcacacagaccccaaccacgaccccaacacccaccagcacaaagagtacaaccgtgacacccatcaccaccacaactacggtgaccgcaaccccaacacccaccggcacacagaccccaaccatgatacccatcagcaccaccactacggtgacccca

SEQ ID NO: 155589 - DNA, 393 bp, Homo sapiens
  Payload ID: 10592
  Gene Symbol: MUC2
  Gene Name: mucin 2, oligomeric mucus/gel-forming
  ENST ID: ENST00000620037
  CDS Start-End: 1-393
ttcgacggactctactacagctaccagggcaactgcacctacgtgctggtggaggagatcagcccctccgtggacaacttcggagtttacatcgacaactaccactgcgatcccaacgacaaggtgtcctgtccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgt

SEQ ID NO: 155590 - DNA, 8637 bp, Homo sapiens
  Payload ID: 10592
  Gene Symbol: MUC2
  Gene Name: mucin 2, oligomeric mucus/gel-forming
  ENST ID: ENST00000630886
  CDS Start-End: 28-8481
caacccacaccgcccctgccagccaccatggggctgccactagcccgcctggcggctgtgtgcctggccctgtctttggcagggggctcggagctccagacagagggcagaacccgaaaccacggccacaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggaaggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccaccaccttcaccactaccaccaccaccaccaccccgacctccagcacagttttatcaacaactccgaagctgtgctgcctctggtctgactggatcaatgaggaccaccccagcagtggcagcgacgacggtgaccgagaaacatttgatggggtctgcggggcccctgaggacatcgagtgcaggtcggtcaaggatccccacctcagcttggagcagctaggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccagcacgaccacccttccaccaaccaccacccccagccctccaaccaccaccacaaccacccctccaccaaccaccacccccagccctccaataaccaccacgaccacccctccaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaacgactacgcccatcactccaccagccagcactaccacccttccaccaaccaccactcccagccctccaacaaccaccacaaccacccctccaccaaccaccactcccatcaccaccaccaccacggtgaccccaaccccaacacccaccggcacacagaccccaacaacgacacccatcaccaccaccaccacggtgaccccaaccccaacacccaccggcacacagaccccaacatcgacacccatcaccaccaccactacggtgaccccaaccccaacacccaccggcacacagaccccaaccacgacacccatcaccaccaccactacggtgaccccaaccccaacacccactggcacacagaccccaaccccaacagccatcaccaccaccactacggtgaccccaaccccaacacccaccggcacacagaccccaaccacgacacccatcaccaccaccactacggtgacaccaaccccaacacccaccggcacacagtccccaaccccaacagccatcaccaccaccactacggtgaccccaaccccaacacccaccggcacacagaccccaacatcgacacccatcaccaccaccactacggtgaccccaaccccaacacccaccggcacacagaccccaaccccgacacccatctccaccaccactacggtgaccccaaccccaacacccaccggcacacagaccccaaccacgacacccatcaccaccaccaccacggtgaccccaaccccgacacccaccggcacacagaccccaaccacggtactcatcaccaccaccactacgatgaccccaaccccaacacccaccagcacaaagagtacaaccgtgacacccatcaccaccacaactacggtgaccgcaaccccaacacccaccggcacacagaccccaaccatgatacccatcagcaccaccactacggtgaccccaaccccaacacccaccactggaagcacggggccccccacccacacaagcacagcacccattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgtccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgctgt

SEQ ID NO: 155591 - DNA, 1916 bp, Homo sapiens
  Payload ID: 10593
  Gene Symbol: MUC20
  Gene Name: mucin 20, cell surface associated
  ENST ID: ENST00000320736
  CDS Start-End: 14-1630
gtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacc

SEQ ID NO: 155592 - DNA, 2463 bp, Homo sapiens
  Payload ID: 10593
  Gene Symbol: MUC20
  Gene Name: mucin 20, cell surface associated
  ENST ID: ENST00000436408
  CDS Start-End: 125-2296
atttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctgagtatctgggactacaggtgccaccaccatgctcggctaattttttgaatttttagtagagacggagtttcaccgtgtcagccagcctggtctcaaactcctgacctcaagtgatccacccacctcggcctcccaaagtgctgggattccagttaatgagcactgctc

SEQ ID NO: 155593 - DNA, 521 bp, Homo sapiens
  Payload ID: 10593
  Gene Symbol: MUC20
  Gene Name: mucin 20, cell surface associated
  ENST ID: ENST00000423938
  CDS Start-End: 1-385
accgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagttgatgacacagggcacccacagcgctcacgtgccttccatggtgggggtgaatcctttgccaatagtgcctggtgggtttcagcactgaataatattccatcgtctgaatgcaccataggttatttacccgttcacctgctgaaggacatcttggttgcttccaagttttggcaattatgaataaagctgctataaattatgaataaagctgctataaacctcca

SEQ ID NO: 155594 - DNA, 2842 bp, Homo sapiens
  Payload ID: 10593
  Gene Symbol: MUC20
  Gene Name: mucin 20, cell surface associated
  Uniprot ID: Q8N307
  ENST ID: ENST00000445522
  CDS Start-End: 483-2507
ggcctttctcgtcttttaagggtttttacttccatggggaactatgtgttggatgagaaaagtatccggggaaggggacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacaccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaacgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccaga

SEQ ID NO: 155595 - DNA, 2589 bp, Homo sapiens
  Payload ID: 10593
  Gene Symbol: MUC20
  Gene Name: mucin 20, cell surface associated
  Uniprot ID: Q8N307
  ENST ID: ENST00000447234
  CDS Start-End: 127-2256
acatttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggccca

SEQ ID NO: 155596 - DNA, 2326 bp, Homo sapiens
  Payload ID: 10593
  Gene Symbol: MUC20
  Gene Name: mucin 20, cell surface associated
  ENST ID: ENST00000619358
  CDS Start-End: 483-1994
ggcctttctcgtcttttaagggtttttacttccatggggaactatgtgttggatgagaaaagtatccggggaaggggacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacaccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaacgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggccc

SEQ ID NO: 155597 - DNA, 2589 bp, Homo sapiens; identical to SEQ ID NO: 155595
  Payload ID: 10593
  Gene Symbol: MUC20
  Gene Name: mucin 20, cell surface associated
  Uniprot ID: Q8N307
  ENST ID: ENST00000620530
  CDS Start-End: 127-2256

SEQ ID NO: 155598 - DNA, 2329 bp, Homo sapiens
  Payload ID: 10593
  Gene Symbol: MUC20
  Gene Name: mucin 20, cell surface associated
  ENST ID: ENST00000614780
  CDS Start-End: 483-1994
ggcctttctcgtcttttaagggtttttacttccatggggaactatgtgttggatgagaaaagtacccggggaaggcgacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacgccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaatgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctaaccccagatgtggcaacaggaccctcgctcacatccaccggagtgtatgtatggggaggggcttcacctgttcccagaggtgtccttggactcaccttggcacatgttctgtgtttcagtaaagagagacctgatcacccatctgtgtgcttccatcctgcattaaaattcactcagtgtggcccaga

SEQ ID NO: 155599 - DNA, 2589 bp, Homo sapiens; identical to SEQ ID NO: 155595
  Payload ID: 10593
  Gene Symbol: MUC20
  Gene Name: mucin 20, cell surface associated
  Uniprot ID: Q8N307
  ENST ID: ENST00000610415
  CDS Start-End: 127-2256

SEQ ID NO: 155600 - DNA, 2124 bp, Homo sapiens
  Payload ID: 10593
  Gene Symbol: MUC20
  Gene Name: mucin 20, cell surface associated
  ENST ID: ENST00000616892
  CDS Start-End: 124-1791
acatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacactgagcgctgagacctcttctagggcctcaaccccagccggccccgttccagaagcagagaccaggggatccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatcccatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacgattgggaccccactccccaccaacagcaccatagaaagagaagtgacagcacccggggccacgaccctcagtggagctctggccacagggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacactgaccacggacatcgcaaccaaggggcccttccccaccagcagggaccctcttccttctgtccctccaactacaaccaacagcagccgagggacgaacagcaccttagccaagatcacaacctcagcgaagaccacgatgaagcccccaacagccacgcccacgactgcccggacgaggccgaccacagacatgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggccca

SEQ ID NO: 155601 - DNA, 2326 bp, Homo sapiens; identical to SEQ ID NO: 155596
  Payload ID: 10593
  Gene Symbol: MUC20
  Gene Name: mucin 20, cell surface associated
  ENST ID: ENST00000610497
  CDS Start-End: 483-1994

SEQ ID NO: 155602 - DNA, 2329 bp, Homo sapiens
  Payload ID: 10593
  Gene Symbol: MUC20
  Gene Name: mucin 20, cell surface associated
  ENST ID: ENST00000616630
  CDS Start-End: 483-1994
gcctttctcgtcttttaagggttttttacttccatggggaactatgtgttggatgagaaaagtacccggggaaggcgacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacgccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaatgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctaaccccagatgtggcaacaggaccctcgctcacatccaccggagtgtatgtatggggaggggcttcacctgttcccagaggtgtccttggactcaccttggcacatgttctgtgtttcagtaaagagagacctgatcacccatctgtgtgcttccatcctgcattaaaattcactcagtgtggcccaga

SEQ ID NO: 155603 - DNA, 2589 bp, Homo sapiens; identical to SEQ ID NO: 155595
  Payload ID: 10593
  Gene Symbol: MUC20
  Gene Name: mucin 20, cell surface associated
  Uniprot ID: Q8N307
  ENST ID: ENST00000615394
  CDS Start-End: 127-2256

SEQ ID NO: 155604 - DNA, 2326 bp, Homo sapiens; identical to SEQ ID NO: 155596
  Payload ID: 10593
  Gene Symbol: MUC20
  Gene Name: mucin 20, cell surface associated
  ENST ID: ENST00000618903
  CDS Start-End: 483-1994

SEQ ID NO: 155605 - DNA, 521 bp, Homo sapiens
  Payload ID: 10593
  Gene Symbol: MUC20
  Gene Name: mucin 20, cell surface associated
  ENST ID: ENST00000625530
  CDS Start-End: 1-385
accgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgtggctgagtgtggcttccccggaagacctcactgaccccagagtggcagaaaggctgatgcagcagttgatgacacagggcacccacagcgctcacgtgccttccatggtgggggtgaatcctttgccaatagtgcctggtgggtttcagcactgaataatattccatcgtctgaatgcaccataggttatttacccgttcacctgctgaaggacatcttggttgcttccaagttttggcaattatgaataaagctgctataaattatgaataaagctgctataaacctcca

SEQ ID NO: 155606 - DNA, 518 bp, Homo sapiens
  Payload ID: 10593
  Gene Symbol: MUC20
  Gene Name: mucin 20, cell surface associated
  ENST ID: ENST00000627326
  CDS Start-End: 1-382
gaccacggacatcgcaaccaaggggcccttccccaccagcagggaccctcttccttctgtccctccaactacaaccaacagcagccgagggacgaacagcaccttagccaagatcacaacctcagcgaagaccacgatgaagcccccaacagccacgcccacgactgcccggacgaggccgaccacagacatgagtgcaggtgaaaatggaggtttcctcctcctgcggctgagtgtggcttccccggaagacctcactgaccccagagtggcagaaaggctgatgcagcagttgatgacacagggcacccacagcgctcacgtgccttccatggtgggggtgaatcctttgccaatagtgcctggtgggtttcagtactgaataatattccatcgtctgaatgcaccataggttatttacccgttcacctgctgaaggacatcttggttgcttccaagttttggcaattatgaataaagctgctataaattatgaataaagctgctataaacctcca

SEQ ID NO: 155607 - DNA, 2842 bp, Homo sapiens; identical to SEQ ID NO: 155594
  Payload ID: 10593
  Gene Symbol: MUC20
  Gene Name: mucin 20, cell surface associated
  Uniprot ID: Q8N307
  ENST ID: ENST00000625274
  CDS Start-End: 483-2507

SEQ ID NO: 155608 - DNA, 2842 bp, Homo sapiens; identical to SEQ ID NO: 155594
  Payload ID: 10593
  Gene Symbol: MUC20
  Gene Name: mucin 20, cell surface associated
  Uniprot ID: Q8N307
  ENST ID: ENST00000627739
  CDS Start-End: 483-2507

SEQ ID NO: 155609 - DNA, 521 bp, Homo sapiens; identical to SEQ ID NO: 155593
  Payload ID: 10593
  Gene Symbol: MUC20
  Gene Name: mucin 20, cell surface associated
  ENST ID: ENST00000631327
  CDS Start-End: 1-385

SEQ ID NO: 155610 - DNA, 2842 bp, Homo sapiens; identical to SEQ ID NO: 155594
  Payload ID: 10593
  Gene Symbol: MUC20
  Gene Name: mucin 20, cell surface associated
  Uniprot ID: Q8N307
  ENST ID: ENST00000630334
  CDS Start-End: 483-2507

SEQ ID NO: 155611 - DNA, 2463 bp, Homo sapiens; identical to SEQ ID NO: 155592
  Payload ID: 10593
  Gene Symbol: MUC20
  Gene Name: mucin 20, cell surface associated
  ENST ID: ENST00000629777
  CDS Start-End: 125-2296

SEQ ID NO: 155612 - DNA, 2064 bp, Homo sapiens
  Payload ID: 10593
  Gene Symbol: MUC20
  Gene Name: mucin 20, cell surface associated
  ENST ID: ENST00000628575
  CDS Start-End: 124-1731
acatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacatctctgaagaggcaaagacactcacaatggacatattgacattggctcacacctccacagaagctaagggcctgtcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgtggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctaaccccagatgtggcaacaggaccctcgctcacatccaccggagtgtatgtatggggaggggcttcacctgttcccagaggtgtccttggactcaccttggcacatgttctgtgtttcagtaaagagagacctgatcacccatctgtgtgcttccatcctgcattaaaattcactcagtgtggccca

SEQ ID NO: 155613 - DNA, 2463 bp, Homo sapiens; identical to SEQ ID NO: 155592
  Payload ID: 10593
  Gene Symbol: MUC20
  Gene Name: mucin 20, cell surface associated
  ENST ID: ENST00000627975
  CDS Start-End: 125-2296

SEQ ID NO: 155614 - DNA, 521 bp, Homo sapiens; identical to SEQ ID NO: 155593
  Payload ID: 10593
  Gene Symbol: MUC20
  Gene Name: mucin 20, cell surface associated
  ENST ID: ENST00000626015
  CDS Start-End: 1-385

SEQ ID NO: 155615 - DNA, 2380 bp, Homo sapiens
  Payload ID: 10593
  Gene Symbol: MUC20
  Gene Name: mucin 20, cell surface associated
  ENST ID: ENST00000630313
  CDS Start-End: 483-2045
ggcctttctcgtcttttaagggtttttacttccatggggaactatgtgttggatgagaaaagtacccggggaaggcgacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacgccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaatgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacactgagcgctgagacctcttctagggcctcaaccccagccggccccgttccagaagcagagaccaggggatccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatcccatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacgattgggaccccactccccaccaacagcaccatagaaagagaagtgacagcacccggggccacgaccctcagtggagctctggccacagggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacactgaccacggacatcgcaaccaaggggcccttccccaccagcagggaccctcttccttctgtccctccaactacaaccaacagcagccgagggacgaacagcaccttagccaagatcacaacctcagcgaagaccacgatgaagcccccaacagccacgcccacgactgcccggacgaggccgaccacagacatgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccaga

SEQ ID NO: 155616 - DNA, 521 bp, Homo sapiens; identical to SEQ ID NO: 155593
  Payload ID: 10593
  Gene Symbol: MUC20
  Gene Name: mucin 20, cell surface associated
  ENST ID: ENST00000626524
  CDS Start-End: 1-385

SEQ ID NO: 155617 - DNA, 521 bp, Homo sapiens; identical to SEQ ID NO: 155593
  Payload ID: 10593
  Gene Symbol: MUC20
  Gene Name: mucin 20, cell surface associated
  ENST ID: ENST00000625420
  CDS Start-End: 1-385

SEQ ID NO: 155618 - DNA, 521 bp, Homo sapiens; identical to SEQ ID NO: 155593
  Payload ID: 10593
  Gene Symbol: MUC20
  Gene Name: mucin 20, cell surface associated
  ENST ID: ENST00000628313
  CDS Start-End: 1-385

SEQ ID NO: 155619 - DNA, 1950 bp, Homo sapiens
  Payload ID: 10593
  Gene Symbol: MUC20
  Gene Name: mucin 20, cell surface associated
  ENST ID: ENST00000626170
  CDS Start-End: 125-1783
atttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctgagtatctgggactacaggtgccaccaccatgctcggctaattttttgtatttttagtagagacggagtttcaccgtgtcagccagcctggtctcaaactcctgacctcaagtgatccacccacctcggcctcccaaagtgctgggattccagttaatgagcactgctc

SEQ ID NO: 155620 - DNA, 1938 bp, Homo sapiens
  Payload ID: 10593
  Gene Symbol: MUC20
  Gene Name: mucin 20, cell surface associated
  ENST ID: ENST00000629965
  CDS Start-End: 122-1771
atttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacatctctgaagaggcaaagacactcacaatggacatattgacattggctcacacctccacagaagctaagggcctgtcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgtggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctgagtatctgggactacaggtgccaccaccatgctcggctaattttttgtatttttagtagagacggagtttcaccgtgtcagccagcctggtctcaaactcctgacctcaagtgatccacccacctcggcctcccaaagtgctgggattccagttaatgagcaccgctc

SEQ ID NO: 155621 - DNA, 1950 bp, Homo sapiens; identical to SEQ ID NO: 155619
  Payload ID: 10593
  Gene Symbol: MUC20
  Gene Name: mucin 20, cell surface associated
  ENST ID: ENST00000630818
  CDS Start-End: 125-1783

SEQ ID NO: 155622 - DNA, 1998 bp, Homo sapiens
  Payload ID: 10593
  Gene Symbol: MUC20
  Gene Name: mucin 20, cell surface associated
  ENST ID: ENST00000627868
  CDS Start-End: 122-1831
atttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacactgagcgctgagacctcttctagggcctcaaccccagccggccccgttccagaagcagagaccaggggatccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatcccatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacgattgggaccccactccccaccaacagcaccatagaaagagaagtgacagcacccggggccacgaccctcagtggagctctggccacagggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacactgaccacggacatcgcaaccaaggggcccttccccaccagcagggaccctcttccttctgtccctccaactacaaccaacagcagccgagggacgaacagcaccttagccaagatcacaacctcagcgaagaccacgatgaagcccccaacagccacgcccacgactgcccggacgaggccgaccacagacatgagtgcaggtgaaaatggaggtttcctcctcctgcggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctgagtatctgggactacaggtgccaccaccatgctcggctaattttttgaatttttagtagagacggagtttcaccgtgtcagccagcctggtctcaaactcctgacctcaagtgatccacccacctcggcctcccaaagtgctgggattccagttaatgagcactgctc

SEQ ID NO: 155623 - DNA, 2076 bp, Homo sapiens
  Payload ID: 10593
  Gene Symbol: MUC20
  Gene Name: mucin 20, cell surface associated
  ENST ID: ENST00000627719
  CDS Start-End: 127-1743
acatttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctaaccccagatgtggcaacaggaccctcgctcacatccaccggagtgtatgtatggggaggggcttcacctgttcccagaggtgtccttggactcaccttggcacatgttctgtgtttcagtaaagagagacctgatcacccatctgtgtgcttccatcctgcattaaaattcactcagtgtggccca

SEQ ID NO: 155624 - DNA, 2463 bp, Homo sapiens; identical to SEQ ID NO: 155592
  Payload ID: 10593
  Gene Symbol: MUC20
  Gene Name: mucin 20, cell surface associated
  ENST ID: ENST00000629752
  CDS Start-End: 125-2296

SEQ ID NO: 155625 - DNA, 2322 bp, Homo sapiens
  Payload ID: 10593
  Gene Symbol: MUC20
  Gene Name: mucin 20, cell surface associated
  ENST ID: ENST00000626408
  CDS Start-End: 482-1987
gcctttctcgtcttttaagggtttttacttccatggggaactatgtgttggatgagaaaagtacccggggaaggcgacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacgccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaatgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacatctctgaagaggcaaagacactcacaatggacatattgacattggctcacacctccacagaagctaagggcctgtcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgtggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctaaccccagatgtggcaacaggaccctcgctcacatccaccggagtgtatgtatggggaggggcttcacctgttcccagaggtgtccttggactcaccttggcacatgttctgtgtttcagtaaagagagacctgatcacccatctgtgtgcttccatcctgcattaaaattcactcagtgtggcccaga

SEQ ID NO: 155626 - DNA, 2076 bp, Homo sapiens; identical to SEQ ID NO: 155623
  Payload ID: 10593
  Gene Symbol: MUC20
  Gene Name: mucin 20, cell surface associated
  ENST ID: ENST00000629220
  CDS Start-End: 127-1743

SEQ ID NO: 155627 - DNA, 3651 bp, Homo sapiens
  Payload ID: 10594
  Gene Symbol: MUC21
  Gene Name: mucin 21, cell surface associated
  Uniprot ID: Q5SSG8
  ENST ID: ENST00000376296
  CDS Start-End: 242-1942
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 155628 - DNA, 3831 bp, Homo sapiens
  Payload ID: 10594
  Gene Symbol: MUC21
  Gene Name: mucin 21, cell surface associated
  ENST ID: ENST00000383535
  CDS Start-End: 242-2122
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagtcaccaactctgggtccagtgtgacctccagtggagccagcactgccaccaactctgagtccagcacagtgtccagtagggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacagtgtccagtggggccagcactgccaccaactctgagtccagcacgacctccagtggggctagcacagccaccaactctgactccagcacaacctccagtggggccggcacagccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggagtggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccctgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttcgcctcccaaagtgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 155629 - DNA, 3651 bp, Homo sapiens
  Payload ID: 10594
  Gene Symbol: MUC21
  Gene Name: mucin 21, cell surface associated
  ENST ID: ENST00000451480
  CDS Start-End: 242-1942
agagaaagaggcaactacattgcctggaggaagcctaaggaacccaggcatccagctgcccacgcccgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacaacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcctgtggccacctcagacatcacttctctttggaagactccattaaatatttctctgtgagaaa

SEQ ID NO: 155630 - DNA, 3651 bp, Homo sapiens
  Payload ID: 10594
  Gene Symbol: MUC21
  Gene Name: mucin 21, cell surface associated
  ENST ID: ENST00000440457
  CDS Start-End: 242-1942
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 155631 - DNA, 3651 bp, Homo sapiens
  Payload ID: 10594
  Gene Symbol: MUC21
  Gene Name: mucin 21, cell surface associated
  ENST ID: ENST00000420532
  CDS Start-End: 242-1942
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagtcaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 155632 - DNA, 3651 bp, Homo sapiens; identical to SEQ ID NO: 155630
  Payload ID: 10594
  Gene Symbol: MUC21
  Gene Name: mucin 21, cell surface associated
  ENST ID: ENST00000430305
  CDS Start-End: 242-1942

SEQ ID NO: 155633 - DNA, 3741 bp, Homo sapiens
  Payload ID: 10594
  Gene Symbol: MUC21
  Gene Name: mucin 21, cell surface associated
  ENST ID: ENST00000457728
  CDS Start-End: 242-2032
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagtcaccaactctgggtccagtgtgacctccagtggagccagcactgccaccaactctgagtccagcacagtgtccagtagggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacagtgtccagtggggccagcactgccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccctgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttcgcctcccaaagtgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 155634 - DNA, 3656 bp, Homo sapiens
  Payload ID: 10594
  Gene Symbol: MUC21
  Gene Name: mucin 21, cell surface associated
  ENST ID: ENST00000551904
  CDS Start-End: 252-1952
ctttcacaacagagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacaacctccagtggggccggcacagccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggagtggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccctgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttcgcctcccaaagtgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtg

SEQ ID NO: 155635 - DNA, 1880 bp, Homo sapiens
  Payload ID: 10594
  Gene Symbol: MUC21
  Gene Name: mucin 21, cell surface associated
  ENST ID: ENST00000549059
  CDS Start-End: 187-1437
ctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattg

SEQ ID NO: 155636 - DNA, 1880 bp, Homo sapiens
  Payload ID: 10594
  Gene Symbol: MUC21
  Gene Name: mucin 21, cell surface associated
  ENST ID: ENST00000547599
  CDS Start-End: 187-1437
ctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgagtccagcacaacctccagtggggccagcacagccaccaactctgagtccagcacaacctccagtggggccagcacagccaccaactctgagtccagcacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattg

SEQ ID NO: 155637 - DNA, 2527 bp, Homo sapiens
  Payload ID: 10594
  Gene Symbol: MUC21
  Gene Name: mucin 21, cell surface associated
  ENST ID: ENST00000486149
  CDS Start-End: 1746-2084
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctggtgagtgattttatttaaaatcgggtggtctgagaacctttgaggagttgggagagaaatgtgaccactactggggccagctctgcttctcttccatagagtgaggatcatcattttactcgaatcacttcagcctaacaagcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattg

SEQ ID NO: 155638 - DNA, 1886 bp, Homo sapiens
  Payload ID: 10594
  Gene Symbol: MUC21
  Gene Name: mucin 21, cell surface associated
  ENST ID: ENST00000621782
  CDS Start-End: 187-1443
ctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgagtccagcacaacctccagtggggccagcacagccaccaactctgagtccagcacaacctccagtggggccggcacagccaccaactctgagtccagcacgacctccagtggggccagcacagccaccaactctgagtccagcacgaccacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattg

SEQ ID NO: 155639 - DNA, 6019 bp, Homo sapiens
  Payload ID: 10595
  Gene Symbol: MUC22
  Gene Name: mucin 22
  Uniprot ID: E2RYF6
  ENST ID: ENST00000561890
  CDS Start-End: 234-5555
aaaaaagaagaaaaataagaagccaaactgtggagcaatttgggggctccccccaaccatgccatctgcctacaaggcttaccctggcactggctggcctttgggtctttttgtgcaactttattttctatcaaggcccagggggtttgccccttgtctctctgcctctttgacctatccttcctttggaacccaggcatctaaatgacaacttctatgtgcatcatttagagatgagaagaggaaatatctctcctgctttctggttcctgtggctgcttctctttggacttctgggacccagctctgagaataccacagccttcacaaaaggctccgacaccaccacagcctccatcacaggctctgagaccaccatggcctccaccatggcctctacttcggccttaactacaggctctaagatcaccacagactctaccacaggctctgagacaacctcagcctccaccatggcttctactgcagccttcaccacaggctctgagaccaacacggcctccaccacagactcagggactactatagcctccactaggaccttcaccacaggctctgacacaaccacaggctccactgcaggctctgaaactatcgtggcctccaccacagtctctgggaccacaacaacctttactatagcctccactacagtccctgagactaccatggcctccagcacaacctccactgcaggctctgagaaaacgatggcctcctccataatttctgagaccaccatggcctccaccacaggctctgagactgccacagtctctaccacaggctctgagaccaccaccacctccactgcaagctctgaggccactaaagtctctaccacaggctctgaaaccaccacagcatctactgcaggttctgagaccaccactacctccacctccatggcaggctctgaggccaccacaacctcaactgcagactccaaggtgatcacggcatccagcatgagctctgagaccactgtggcccccgctgcaggctctaacaccaccacagcctctaccacaggctctgagaccactacaatcctgattaaagcctctgagaccaccacagcctctacagcaggttctgagaccaccaccccctcccccacaggctctcagaccaccatagtctctatttcaggttctgagatcaccaccacctctacggcaggatccgagaacaccacagtctctagtgcaggctctgggaccaccacagcttctatggcaggctctgagaccaccgtctccactgcaggctctgagaccactacagtctctatcacaggcactgagaccaccatggtctctgccatgggctcagagaccaccacaaactctactacaagctctgagaccaccgtcacctctactgcaggctctgagaccaccacagtctccaccgtgggctctgagaccaccacagcctatactgcagattctgagaccactgcagcctctaccacaggctctgagatgaccacagtcttcactgcaggctcggaaaccatcacaccctctactgcaggctcagagaccaccacagtctctactgcaggctctgagaccactacagtctccaccacaggctctgagaccacaacagcctctactgcacattctgagacgactgcagcctccaccatgggctctgagaccaccaaagtctcaactgcaggctctgagaccacagtctccactgcaggctctgagaccactgcagcctctactgaagattctgaaaccaacacagcatttactgaagattctaagactaccacagcctctactacagggtttgagacaaccgcagcctctactacaggctctgagcctaccatggcatccaccatgggctctgagaccactatggcctctaccataggccctgagaccaccaaggtctccactgcaagctctgaggtgaccacagtctttgctgcaggctctgagacaatcagagcctctaccgtaggctctgagaccaccacagtctctaccacaggctctgagaccaccacagcctccatcatgggctctgagaccagcacagattctaccacaggctctgagaccaccacagcctctactgaaggctctgagaccaccacagcttccactgaaggctctgaggccactacagtctccaccacaggctctgagaccactacagtttctatcacagactcagagaccaccaccacctgtactgaaggctctgagatgactgcagtctccaccacagtctttgagaccactacagcctctactgaaggctctgagatcacaatagcctctacttcagactctgagaccaccacagcttctactgaaggttctgagaccactacagtcactaccgcaggctctgagaccaaaacagcctatactacaggctctgagaccaccacagcctctaatacaggcttggagaccaccacagtctttaccataggctctgacaccaccacagcctctactgaaggctctgagaccactgcagtctctgccacaggctctgagatgaccacagtctctactgaaggctctgagaacactacagtctccaccacaggctctgagaccactacagtttccaccacaggcttggagaccaccaccacttccactgaaggctctgagatgactacagtctccaccacaggtgctgagaccaccacagactctactgaaggctctgggaccactgcagcctccactgcaggctctgagaccaccacagtctctactgcagattctgagaacaccacagcatctactgcagattctgagaccacctcagcctctactacaggctctgagaccaccacagcctctactacaagctctgagaccaccacagcctctactgaaggctctgagaccactacagtctccaccacagactctgagaccaccatggtctctaccacaggctctgagaggaccatcacctctactgaaggctctgagaccactacagtatctgccacaggctctgagaccacagtctctactgaaggctctgggaccactacagtctccatcacaggctctgagaccactaaagtttctaccacaggttcagagaccaccaccacttctactgaaggctctgagattactacagcctccatcacaggctctgagaccaccacagcctctactgaaggctccgagaccaccacagcctctactgaaggctccgagaccacctcagcctctactacaggctctgagaccaccacagcctctactacaagctctgagaccaccatggcatccatcatgggctctgagaccactatggcctctaccataggctctgagaccaccaaggtctccactgcaagctctaaaatgaccacagtcttcactgaaaactctgagaccaccatagcctctaccacagcctctgagaccaccacagtctccactgcaggctctgagaccatcccagcctctacagcaggctctgagaccaccaccaccacctctactgaaggctctgagaccactacagcctctactgaaggctctgagaccaccacagcctctactgaaagctctgagaccactacagccactaccataggctctgagaccaccacagcctctactgaaggctctgagactaccaccacctctactgaaggctctgagaccaccacagcctctactgaaggctctgagatcactacagtttctaccacaggctctgagaccaccacagcctctactgaaggctctgagaccaccacagcctctactgaaggctctgagctcactacagtttctaccacaggctctgagaccatcacagtctctgctgaaggctctgagaccactacagtcactactatgggctctgagaccaccacggcctctactgcaggctcagagaccaccacagtctctactgcaggctctgagaccaccacagcctctattgaaggctctgagaccactacagtctcctccacaggctctgagaccaccacagtctctaccacaggcactgagactaccatcacctctactgaaggttcagagaccactacagtcactactgcaggttctgagaccacagcagtctataccacaggctctgagactaccaccacctctactgaaggctctgagacaaccacagtctctaccacgggctctgagaccaccacagcctctaccgcagatttggagaccaccacagtctccacctcaggctctgggaccaccacagcctctaccgcaggctctgagaccacaacagtctatatcacaggctctaagactaccaccgcctctactgaaggctctgaggccactacagtttctaccactagctctgagaccaccacagcctctaccacaggctctgagatgactacagtctttaccacagtctctgagaccaccacagtctctaccataggctctgaggccaccacatcctctgctgcaggctctgaggccaccaccacctctactgaaggctctgagaccaccacagcctccactgcaggctctgagaccaccacagcctccactgcaggctctgagaccaccacagcctccacttcaggctctgagaccaacacagcctgtaccacaggttctgagacctccacaccctccagtgcaggctctgagaccaacactgccttcatcataggctctgagagcaccatagcttccactgcaagcttggagcccactgcaacttccctcacaggctctgagaccaccacagtctctatcacagcttctggggccactgcagcctccaccactgtctcttccaccacgtttgtactcaccaaggccactgacgtttctatccagcccatcaccaacacacctatgtcaggcaccagaaccactggaaccagactcactgcctccagctctgtcaccatggcccctggaatggacttcacggcctctgctgccagccatactgtgccaggaatagtcttaaacacctctggcctgggtacatccactatgggagcatcatctaccacctcagcccacggcgtcaggaccaccacaggatccacccgtgagccaaccagcagcaccttccaggaaacaggcccggtgtccatgggcacaaacacagttagcatgagccacacacccacaaacgtgatcaaaccaagtggatatttacagccctgggctatcatcctcatttccctggctgcagttgtggctgctgttggattgtcagtaggactgagtttttgtctgagaaaccttttcttccccctgagatattgtggtatttattacccccatggccacagccacagccttggtctggacctgaacttgggcctgggctctgggacattccacagcctgggaaatgcactggttcatggaggagaacttgaaatgggacatggaggaacacacggctttggatatggagtgggccatggactgagccacatccatggagatggctacggagtgaatcatggcgggcattatggacatggaggaggccactgaggacaccatggagtggatcacagagggagccaccaaggaggccacggcaggacaagatggctgtggccatagattgggtatcaaaacatattatgggtgggagggggtcatggaggagaaaaaaataatgatcatgaaataattaaaatggagcataggaagcttcccaggatgtgatccatggagatggacatggactaggtcaagaaaagaaccagcaaaaggacctcagagactttgactggcttggaggggacttcaagtcaaagcttctgtgagtttttcctgagtctcagcctctgttgtggggagtcacgacaaccaccctcaggacatcttctctcccatttcccgccacatcagggtcaacgtttctcatccctgtgtttcctcatggtgctataaatattaccaagacatgtctaagaaacaaaagcacataatgaatgtattatcagggccac

SEQ ID NO: 155640 - DNA, 11226 bp, Homo sapiens
  Payload ID: 10596
  Gene Symbol: MUC3A
  Gene Name: mucin 3A, cell surface associated
  ENST ID: ENST00000379458
  CDS Start-End: 71-10042
cagggccacgtccctgccgctgtcttggtcctgaagcctgttctgccccagccccctgcccgctgggcccatgcagctgttggggctcctcggcctcctctggatgctcaaggcctccccgtgggccacaggaactttatccacggccacatccatctctcaagtgcctttccccagagcagaagcagccagcgctgtgctcagcaattctccacactccagagacctggctgggtggccacttggtgtcccccagctcgcctctcctgctcctggccacagggaaaatgcacctatgacactcactacctccccccatgacacactcatctctgaaacattgctcaactctccagtcagttccaacacctcaaccaccccgacgtccaagtttgccttcaaggttgaaaccactccacccaccgtgttggtctattcagccaccactgagtgcgtgtatccaacgagctttataatcaccatctcccaccccacctccatctgtgtgaccacgacgcaggtggccttcaccagctcttacacctcgactcccgtgacacagaagccagtgaccaccgtcaccagtacttactctatgaccactactgagaaaggaacgtcagccatgacatcttctccctctaccaccactgcaagggaaactcccatagtgacagtgacaccctcctctgtgtcagccacagacacaaccttccacactacaatctcgtctacaactagaaccacagaaaggactcccctgcccactggaagcatccatacaaccacgtccccaaccccagtatttactactctcaaaacagcagtgacttccacttcccccatcacttcttcaatcacttccacaaatacagtgacttctatgacaacgaccgcctcccagcccacagccactaatacattgtcatcacccactaggaccattttatcttccacacctgtcctgagcacagaaacaatcaccagtggtatcacaaacaccacccccctatccaccttggtgaccacactccccactaccatcagcaggtctacacctacatctgagaccacctacactacttctcccaccagcactgtcacagactccactaccaaaatcgcctactccacaagtatgacaggtacattgtccacagagacttctctcccacccacctcttcctctctcccaaccacagaaacagccacgactcctatgacaaacttggtaaccaccaccactgagatctcctcccacagtactcccagcttctcttcatcaaccatctactccacagtcagcacatccacaactgccatctcctcacttccccctacctcaggtactatggtgacttccacaaccatgaccccatcttctctgagtacagacatccctttcacaacaccaacaactatcacccaccattctgtgggctctaccggtttcctgactacagcaacagacctcacatcaacattcacggtttccagttcctcagcaatgtccacgagtgtcattccatcttcccccagcattcagaatacagaaacctcatcccttgtcagcatgacctctgccactactcccaatgtgagaccaacttttgtaagtacactcagcactcctacaagttccctcctgacgaccttcccagcaacatattcattttcatcttccatgtctgccagcagtgctgggaccactcacacagagagtatctcctcacctccagccagcaccagtacactccacacaacagctgaatccaccctggcacccactaccaccacctcattcacaacttccacaactatggaaccaccttcaaccactgcagcaactacaggaacaggtcagaccaccttcaccagctctacagccacatttcctgagaccaccacaccgactcctacaactgacatgtccacagaatctctcacaacagccatgacttctcctcccatcacttcatcagtcacttccacaaatacagtgacttctatgacaactacgacctctcctcccacaaccaccaattcttttacatcactgaccagtatgcctctgtcttctacacctgtcccaagcacagaagtagtcaccagtggcaccataaacacaatccctccatctatcttggtgaccacactccccactccaaatgcttcatctatgactacatctgagaccacctatcctaattctccgactggtcctggtacaaactccacgacggaaatcacctatcccaccactatgacagagacatcatccactgccacctctcttccacccacctctcccttggtctcaactgcaaaaacagccaaaactcctaccacaaacttggtaaccaccaccaccaagaccacctcacatagtaccaccagcttcacttcttcaaccgtctactccacagccagcacatacacaactgccatcacctcagttcccactacgttgggtaccatggtaacttctacatccatgatctcatctactgtgagtacaggtatccctacctcacaaccaacaaccatcactccctcatccgtgggcatcagtggttcattacctatgatgacagacctcacctcagtgtacacagtctctaacatgtctgcaaggccaacaactgtcattccctcatctcccactgtccagaatacagaaatctcaatctctgttagcatgacgtctgctaccactcccagtggaggaccaactttcacaagtactgagaacactccaacaaggtccctcctgacaagctttccaatgacacattcattctcttcttctatgtctgaaagtagtgctgggaccactcacacagagagtatctcctcacctcgaggcaccaccagtacactccacacaacagttgaatccaccccatcacccactaccaccacctcatttaccacatccacaatgatggaaccaccttcatccactgtatcaactacaggcagaggtcagaccacctttcccagctctacagccacattccctgagaccactacactgactcctacaactgacatttctacagtatctctcacaacagccatgacttctcctccccccgtcagttcttcaatcactcccaccaatacaatgacttctatgagaactacaacctattggcccacagccactaatacattatcaccactcaccagtagcattttatcttctacacctgtcccaagcacagaaatgatcaccagtcataccacaaacaccacccctctatccaccttggtgactacactcctcactaccatcaccagatctacacctacatctgagaccacctaccctacttctcccaccagcattgtctcagactccacgactgaaatcacctattccacaagtataacaggtacattgtccactgccactactctcccacccacctcttcctctctcccaaccacagaaacagccacgatgactcctaccacaaccttgataaccaccacccctaataccacctcccttagtacccccagcttcacttcttcaaccatctactccacagtcagcacatccacaactgccatctcctcagcttcccctacctcaggtaccatggtaacttccacaaccatgaccccatcttctctgagtacagacaccccttccacaacaccaacaactatcacctacccttctgtgggctctaccggtttcctgactacagcaacagacctcacatcaacattcactgtttccagttcctcagcaatgtccacaagtgtcattccatcttcccccagcatccagaatacagaaacctcatcccttgtcagcatgacctctgccaccactcccagtttgagaccaactatcacaagtactgacagcactctaacaagttccctcctgacgaccttcccaagtacatattcattttcatcttccatgtctgccagcagtgcagggaccactcacacagagactatttcctcacttccagccagcaccaatacaatccacacaacagctgaatccgccctggcacccactaccaccacctcattcaccacatccccaacgatggaaccaccttcaaccactgtagcgactacaggcacaggtcagaccaccttccccagctctacagccacattccttgagaccaccacactgactcctacaactgacttttctacagaatctctcacaacagccatgacttctactccccccatcacttcttcaatcactcccaccgatacaatgacttctatgagaactacgacctcttggcccacagccactaatacgttatcaccactcaccagtagcattttatcttctacacctgtcccaagcacagaggtgaccaccagtcataccacaaacaccaatcctgtatccacgttggtgactacactccccattaccatcaccaggtctacacttacatctgagaccgcctaccctagttctcccacaagcactgtcacagagtccacaactgaaatcacctatcccaccactatgacagagacatcatctactgccacctctcttccacccacctcttccttggtctcaaccgcagaaacagccaaaactcctaccacaaacttggtaaccaccaccaccaagaccacctcacatagtaccaccagcttcacttcttcaaccatctactccacagccagcacacccaccactgccatcacctcagttcccactaccttgggtaccatggtgacttctacatccatgatcccatctactgtgagtacaggtatccctacctcacaaccaacaactattactccctcatccgtgggcatcagtggttcattacctatgatgacagacctcacctcagtgtacacagtctccagcatgtctgcaaggccaacaagtgtcattccttcatctcccactgtccagaatacagaaacctcaatctttgttagcatgatgtctgctaccactcccagtggaggaccaactttcacaagtactgagaacactccaacaaggtccctcctgacaagctttccagtgacacattcattttcctcttccatgtctgccagcagtgtagggaccactcacacccagagtatctcctcacccccagccatcaccagtacactccacacaacagctgaatccaccccatcacctacaaccaccatgtcattcacaacatttacaaagatggaaacaccttcatccactgtagcaactacaggcacaggtcagactacattcaccagttcaacagccacatcccctaagaccaccacactgactcctacctctgacatttccacaggatctttcaaaacagccgtgagttctactccccccatcacttcttcaatcacctccacatatacggtgacttcgatgacaactaccacccctctagggcccacagccactaatacgttaccatcatttaccagtagcgtttcatcttctacgcctgtcccaagtacagaagcgatcaccagtggtaccacaaacaccacccctctatctacattggtgaccacattctccaattccgacaccagttctacacctacatctgagaccacctaccctacttctcttactagtgctctcacagattccacgaccagaaccacctattccaccaatatgacaggtacattgtccactgtgacctctcttcgacccacctcttcctctctcctcaccacagtaacagccacagttccaacaacaaacttggtaaccacgaccaccaagatcacctcacacagtactcctagcttcacttcttcaatcgcaaccaccgagaccccctcacacagtactcccagattcacttcttcaatcaccactaccgagaccccctcacacagtactcccagattcacttcttcaatcaccaataccaagaccacctcacacagctctcccagcttcacttcttcgatcaccaccaccgagaccacatcccacaatactcccagcctcacttcttcaatcaccaccaccaagaccacctcacacagtactcccagctacacttctttgatcaccacaaccaccaccacctcacacagtactcccagcttcacttcttccatcaccaccactgagaccacatcccacaatactcccagcttgacttcttcgatcacaaccaccgagaccacatcccatagtactcccagcttcacttcttcgatcaccaccgagaccacatcccacagtactcccagcttcacttcattgatcaccatcaccgagatcacctcacacagtactctcagctacactacctcaatcaccaccaccgagaccccctcacacagtactctcagcttcacttcttcaatcaccaccactgagaccacctcacacagtactcccagcttcacttcctcaatcaccacctctgagatgccctcacacagtactcccagcttcacttcttcgatcaccaccactgagaacgccacacacagtactcccaacttcacttcttcaatcaccaccaccgagaccacatcccacagtactcccagcttcacttctttgatcaccaccacggagaccacctcacacaggtgggggaccaccgagaccacatcctacagtactcccagcttcacttcttcaaataccatcactgagaccacctcacacagtactcccagctacattacctcaatcaccaccaccgagaccccctcaagcagtactcccagcttcagttcttcgatcaccaccactgagaccacatcccacagtactcccggcttcacttcttcaatcaccaccactgagactacatcccacagtactcccagcttcacttcttcgatcaccaccactgagaccacctcacatgatactcccagcttcacttcttcaatcaccaccagtgagaccccctcacacagtactcccagctccacttctttaatcaccaccaccaagaccacctcacacagtactcccagcttcacttcttcgatcaccaccacggagaccacctcacacagtgctcacagcttcacttcttcgatcaccaccaccgagaccacctcacacaatactcgcagcttcacttcttcgatcaccaccaccgagaccaactctcacagtactaccagcttcacttcttcgatcaccaccaccgagaccacctcacacagtactcccagcttcagttcttcaatcaccaccactgagacccccttacacagtactcctggcctcacttcgtgggtcaccaccaccaagaccacctcacacattactcctggcctcacttcttcaatcaccaccactgagactacctcacacagtactcctggcttcacttcttcaatcaccaccactgagaccacctcagagagtactcccagcctcagttcttcaaccatctactccacagtcagcacatccacaactgccatcacctcacattttactacctcagagactgcggtgactcccacacctgtaaccccatcttctctgagtacagacatcccgaccacaagcctacgaactctcaccccttcgtctgtgggcaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaaccccaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttttccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctcccccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccctccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggatacccaggtgctgttctccccgtcaccccgttgcccagttccccgtttctcttgctctcattccttgtatcttctcccttctgagcccgtccattcatcggttctgcccccgactccccctgacctaaataccccagctgctgttccccccatcaccctgctgcccaattctttattctccacccctttctctcacccctggagccctgcgggtgggggcagggcatgagttccccagtccccaaggaaaggcagccccctcagtctccctcctcctcatttccttcgatccccctcccttcttgcctcccctctgccttttaaacccatcccctccgattcccctcctcccccttctcttcctggtgtcacctggattcctgcagtaactctgagcccttgaaatcctcagtcgccttggcggggaagattggctttggggacaggaagtcggcacatctccaggtcttcatgtgcacaatacagagtttattgtaaaaagc

SEQ ID NO: 155641 - DNA, 4399 bp, Homo sapiens
  Payload ID: 10596
  Gene Symbol: MUC3A
  Gene Name: mucin 3A, cell surface associated
  Uniprot ID: Q02505
  ENST ID: ENST00000414964
  CDS Start-End: 1-3007
gatcaccatcaccgagatcacctcacacagtactctcagctacactacctcaatcaccaccaccgagaccccctcacacagtactctcagcttcacttcttcaatcaccaccactgagaccacctcacacagtactcccagcttcacttcctcaatcaccacctctgagatgccctcacacagtactcccagcttcacttcttcgatcaccaccactgagaacgccacacacagtactcccaacttcacttcttcaatcaccaccaccgagaccacatcccacagtactcccagcttcacttctttgatcaccaccacggagaccacctcacacaggtgggggaccaccgagaccacatcctacagtactcccagcttcacttcttcaaataccatcactgagaccacctcacacagtactcccagctacattacctcaatcaccaccaccgagaccccctcaagcagtactcccagcttcagttcttcgatcaccaccactgagaccacatcccacagtactcccggcttcacttcttcaatcaccaccactgagactacatcccacagtactcccagcttcacttcttcgatcaccaccactgagaccacctcacatgatactcccagcttcacttcttcaatcaccaccagtgagaccccctcacacagtactcccagctccacttctttaatcaccaccaccaagaccacctcacacagtactcccagcttcacttcttcgatcaccaccacggagaccacctcacacagtgctcacagcttcacttcttcgatcaccaccaccgagaccacctcacacaatactcgcagcttcacttcttcgatcaccaccaccgagaccaactctcacagtactaccagcttcacttcttcgatcaccaccaccgagaccacctcacacagtactcccagcttcagttcttcaatcaccaccactgagacccccttacacagtactcctggcctcacttcgtgggtcaccaccaccaagaccacctcacacattactcctggcctcacttcttcaatcaccaccactgagactacctcacacagtactcctggcttcacttcttcaatcaccaccactgagaccacctcagagagtactcccagcctcagttcttcaaccatctactccacagtcagcacatccacaactgccatcacctcacattttactacctcagagactgcggtgactcccacacctgtaaccccatcttctctgagtacagacatcccgaccacaagcctacgaactctcaccccttcgtctgtgggcaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaaccccaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttttccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctcccccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccctccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggatacccaggtgctgttctccccgtcaccccgttgcccagttccccgtt

SEQ ID NO: 155642 - DNA, 9944 bp, Homo sapiens
  Payload ID: 10596
  Gene Symbol: MUC3A
  Gene Name: mucin 3A, cell surface associated
  ENST ID: ENST00000483366
  CDS Start-End: 1-9798
atgcagctgttggggctcctcggcctcctctggatgctcaaggcctccccgtgggccacaggaactttatccacggccacatccatctctcaagtgcctttccccagagcagaagcagccagcgctgtgctcagcaattctccacactccagagacctggctgggtggccacttggtgtcccccagctcgcctctcctgctcctggccacagggaaaatgcacctatgacactcactacctccccccatgacacactcatctctgaaacattgctcaactctccagtcagttccaacacctcaaccaccccgacgtccaagtttgccttcaaggttgaaaccactccacccaccgtgttggtctattcagccaccactgagtgcgtgtatccaacgagctttataatcaccatctcccaccccacctccatctgtgtgaccacgacgcaggtggccttcaccagctcttacacctcgactcccgtgacacagaagccagtgaccaccgtcaccagtacttactctatgaccactactgagaaaggaacgtcagccatgacatcttctccctctaccaccactgcaagggaaactcccatagtgacagtgacaccctcctctgtgtcagccacagacacaaccttccacactacaatctcgtctacaactagaaccacagaaaggactcccctgcccactggaagcatccatacaaccacgtccccaaccccagtatttactactctcaaaacagcagtgacttccacttcccccatcacttcttcaatcacttccacaaatacagtgacttctatgacaacgaccgcctcccagcccacagccactaatacattgtcatcacccactaggaccattttatcttccacacctgtcctgagcacagaaacaatcaccagtggtatcacaaacaccacccccctatccaccttggtgaccacactccccactaccatcagcaggtctacacctacatctgagaccacctacactacttctcccaccagcactgtcacagactccactaccaaaatcgcctactccacaagtatgacaggtacattgtccacagagacttctctcccacccacctcttcctctctcccaaccacagaaacagccacgactcctatgacaaacttggtaaccaccaccactgagatctcctcccacagtactcccagcttctcttcatcaaccatctactccacagtcagcacatccacaactgccatctcctcacttccccctacctcaggtactatggtgacttccacaaccatgaccccatcttctctgagtacagacatccctttcacaacaccaacaactatcacccaccattctgtgggctctaccggtttcctgactacagcaacagacctcacatcaacattcacggtttccagttcctcagcaatgtccacgagtgtcattccatcttcccccagcattcagaatacagaaacctcatcccttgtcagcatgacctctgccactactcccaatgtgagaccaacttttgtaagtacactcagcactcctacaagttccctcctgacgaccttcccagcaacatattcattttcatcttccatgtctgccagcagtgctgggaccactcacacagagagtatctcctcacctccagccagcaccagtacactccacacaacagctgaatccaccctggcacccactaccaccacctcattcacaacttccacaactatggaaccaccttcaaccactgcagcaactacaggaacaggtcagaccaccttcaccagctctacagccacatttcctgagaccaccacaccgactcctacaactgacatgtccacagaatctctcacaacagccatgacttctcctcccatcacttcatcagtcacttccacaaatacagtgacttctatgacaactacgacctctcctcccacaaccaccaattcttttacatcactgaccagtatgcctctgtcttctacacctgtcccaagcacagaagtagtcaccagtggcaccataaacacaatccctccatctatcttggtgaccacactccccactccaaatgcttcatctatgactacatctgagaccacctatcctaattctccgactggtcctggtacaaactccacgacggaaatcacctatcccaccactatgacagagacatcatccactgccacctctcttccacccacctctcccttggtctcaactgcaaaaacagccaaaactcctaccacaaacttggtaaccaccaccaccaagaccacctcacatagtaccaccagcttcacttcttcaaccgtctactccacagccagcacatacacaactgccatcacctcagttcccactacgttgggtaccatggtaacttctacatccatgatctcatctactgtgagtacaggtatccctacctcacaaccaacaaccatcactccctcatccgtgggcatcagtggttcattacctatgatgacagacctcacctcagtgtacacagtctctaacatgtctgcaaggccaacaactgtcattccctcatctcccactgtccagaatacagaaatctcaatctctgttagcatgacgtctgctaccactcccagtggaggaccaactttcacaagtactgagaacactccaacaaggtccctcctgacaagctttccaatgacacattcattctcttcttctatgtctgaaagtagtgctgggaccactcacacagagagtatctcctcacctcgaggcaccaccagtacactccacacaacagttgaatccaccccatcacccactaccaccacctcatttaccacatccacaatgatggaaccaccttcatccactgtatcaactacaggcagaggtcagaccacctttcccagctctacagccacattccctgagaccactacactgactcctacaactgacatttctacagtatctctcacaacagccatgacttctcctccccccgtcagttcttcaatcactcccaccaatacaatgacttctatgagaactacaacctattggcccacagccactaatacattatcaccactcaccagtagcattttatcttctacacctgtcccaagcacagaaatgatcaccagtcataccacaaacaccacccctctatccaccttggtgactacactcctcactaccatcaccagatctacacctacatctgagaccacctaccctacttctcccaccagcattgtctcagactccacgactgaaatcacctattccacaagtataacaggtacattgtccactgccactactctcccacccacctcttcctctctcccaaccacagaaacagccacgatgactcctaccacaaccttgataaccaccacccctaataccacctcccttagtacccccagcttcacttcttcaaccatctactccacagtcagcacatccacaactgccatctcctcagcttcccctacctcaggtaccatggtaacttccacaaccatgaccccatcttctctgagtacagacaccccttccacaacaccaacaactatcacctacccttctgtgggctctaccggtttcctgactacagcaacagacctcacatcaacattcactgtttccagttcctcagcaatgtccacaagtgtcattccatcttcccccagcatccagaatacagaaacctcatcccttgtcagcatgacctctgccaccactcccagtttgagaccaactatcacaagtactgacagcactctaacaagttccctcctgacgaccttcccaagtacatattcattttcatcttccatgtctgccagcagtgcagggaccactcacacagagactatttcctcacttccagccagcaccaatacaatccacacaacagctgaatccgccctggcacccactaccaccacctcattcaccacatccccaacgatggaaccaccttcaaccactgtagcgactacaggcacaggtcagaccaccttccccagctctacagccacattccttgagaccaccacactgactcctacaactgacttttctacagaatctctcacaacagccatgacttctactccccccatcacttcttcaatcactcccaccgatacaatgacttctatgagaactacgacctcttggcccacagccactaatacgttatcaccactcaccagtagcattttatcttctacacctgtcccaagcacagaggtgaccaccagtcataccacaaacaccaatcctgtatccacgttggtgactacactccccattaccatcaccaggtctacacttacatctgagaccgcctaccctagttctcccacaagcactgtcacagagtccacaactgaaatcacctatcccaccactatgacagagacatcatctactgccacctctcttccacccacctcttccttggtctcaaccgcagaaacagccaaaactcctaccacaaacttggtaaccaccaccaccaagaccacctcacatagtaccaccagcttcacttcttcaaccatctactccacagccagcacacccaccactgccatcacctcagttcccactaccttgggtaccatggtgacttctacatccatgatcccatctactgtgagtacaggtatccctacctcacaaccaacaactattactccctcatccgtgggcatcagtggttcattacctatgatgacagacctcacctcagtgtacacagtctccagcatgtctgcaaggccaacaagtgtcattccttcatctcccactgtccagaatacagaaacctcaatctttgttagcatgatgtctgctaccactcccagtggaggaccaactttcacaagtactgagaacactccaacaaggtccctcctgacaagctttccagtgacacattcattttcctcttccatgtctgccagcagtgtagggaccactcacacccagagtatctcctcacccccagccatcaccagtacactccacacaacagctgaatccaccccatcacctacaaccaccatgtcattcacaacatttacaaagatggaaacaccttcatccactgtagcaactacaggcacaggtcagactacattcaccagttcaacagccacatcccctaagaccaccacactgactcctacctctgacatttccacaggatctttcaaaacagccgtgagttctactccccccatcacttcttcaatcacctccacatatacggtgacttcgatgacaactaccacccctctagggcccacagccactaatacgttaccatcatttaccagtagcgtttcatcttctacgcctgtcccaagtacagaagcgatcaccagtggtaccacaaacaccacccctctatctacattggtgaccacattctccaattccgacaccagttctacacctacatctgagaccacctaccctacttctcttactagtgctctcacagattccacgaccagaaccacctattccaccaatatgacaggtacattgtccactgtgacctctcttcgacccacctcttcctctctcctcaccacagtaacagccacagttccaacaacaaacttggtaaccacgaccaccaagatcacctcacacagtactcctagcttcacttcttcaatcgcaaccaccgagaccccctcacacagtactcccagattcacttcttcaatcaccactaccgagaccccctcacacagtactcccagattcacttcttcaatcaccaataccaagaccacctcacacagctctcccagcttcacttcttcgatcaccaccaccgagaccacatcccacaatactcccagcctcacttcttcaatcaccaccaccaagaccacctcacacagtactcccagctacacttctttgatcaccacaaccaccaccacctcacacagtactcccagcttcacttcttccatcaccaccactgagaccacatcccacaatactcccagcttgacttcttcgatcacaaccaccgagaccacatcccatagtactcccagcttcacttcttcgatcaccaccgagaccacatcccacagtactcccagcttcacttcattgatcaccatcaccgagatcacctcacacagtactctcagctacactacctcaatcaccaccaccgagaccccctcacacagtactctcagcttcacttcttcaatcaccaccactgagaccacctcacacagtactcccagcttcacttcctcaatcaccacctctgagatgccctcacacagtactcccagcttcacttcttcgatcaccaccactgagaacgccacacacagtactcccaacttcacttcttcaatcaccaccaccgagaccacatcccacagtactcccagcttcacttctttgatcaccaccacggagaccacctcacacaggtgggggaccaccgagaccacatcctacagtactcccagcttcacttcttcaaataccatcactgagaccacctcacacagtactcccagctacattacctcaatcaccaccaccgagaccccctcaagcagtactcccagcttcagttcttcgatcaccaccactgagaccacatcccacagtactcccggcttcacttcttcaatcaccaccactgagactacatcccacagtactcccagcttcacttcttcgatcaccaccactgagaccacctcacatgatactcccagcttcacttcttcaatcaccaccagtgagaccccctcacacagtactcccagctccacttctttaatcaccaccaccaagaccacctcacacagtactcccagcttcacttcttcgatcaccaccacggagaccacctcacacagtgctcacagcttcacttcttcgatcaccaccaccgagaccacctcacacaatactcgcagcttcacttcttcgatcaccaccaccgagaccaactctcacagtactaccagcttcacttcttcgatcaccaccaccgagaccacctcacacagtactcccagcttcagttcttcaatcaccaccactgagacccccttacacagtactcctggcctcacttcgtgggtcaccaccaccaagaccacctcacacattactcctggcctcacttcttcaatcaccaccactgagactacctcacacagtactcctggcttcacttcttcaatcaccaccactgagaccacctcagagagtactcccagcctcagttcttcaaccatctactccacagtcagcacatccacaactgccatcacctcacattttactacctcagagactgcggtgactcccacacctgtaaccccatcttctctgagtacagacatcccgaccacaagcctacgaactctcaccccttcgtctgtgggcaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaaccccaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttttccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctcccccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccctccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatccc

SEQ ID NO: 155643 - DNA, 3982 bp, Homo sapiens
  Payload ID: 10597
  Gene Symbol: MUC4
  Gene Name: mucin 4, cell surface associated
  Uniprot ID: Q99102
  ENST ID: ENST00000346145
  CDS Start-End: 41-3571
ggagcttccccagggagccagggggacttttgccgcagccatgaagggggcacgctggaggagggtcccctgggtgtccctgagctgcctgtgtctctgcctccttccgcatgtggtcccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155644 - DNA, 3806 bp, Homo sapiens
  Payload ID: 10597
  Gene Symbol: MUC4
  Gene Name: mucin 4, cell surface associated
  ENST ID: ENST00000308466
  CDS Start-End: 1-524
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155645 - DNA, 3829 bp, Homo sapiens
  Payload ID: 10597
  Gene Symbol: MUC4
  Gene Name: mucin 4, cell surface associated
  Uniprot ID: Q99102
  ENST ID: ENST00000349607
  CDS Start-End: 41-3418
ggagcttccccagggagccagggggacttttgccgcagccatgaagggggcacgctggaggagggtcccctgggtgtccctgagctgcctgtgtctctgcctccttccgcatgtggtcccaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155646 - DNA, 3777 bp, Homo sapiens
  Payload ID: 10597
  Gene Symbol: MUC4
  Gene Name: mucin 4, cell surface associated
  ENST ID: ENST00000339251
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155647 - DNA, 3645 bp, Homo sapiens
  Payload ID: 10597
  Gene Symbol: MUC4
  Gene Name: mucin 4, cell surface associated
  ENST ID: ENST00000392407
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155648 - DNA, 3944 bp, Homo sapiens
  Payload ID: 10597
  Gene Symbol: MUC4
  Gene Name: mucin 4, cell surface associated
  ENST ID: ENST00000448861
  CDS Start-End: 1-494
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctatcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155649 - DNA, 3716 bp, Homo sapiens
  Payload ID: 10597
  Gene Symbol: MUC4
  Gene Name: mucin 4, cell surface associated
  ENST ID: ENST00000415455
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155650 - DNA, 16197 bp, Homo sapiens
  Payload ID: 10597
  Gene Symbol: MUC4
  Gene Name: mucin 4, cell surface associated
  ENST ID: ENST00000462323
  CDS Start-End: 73-13401
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155651 - DNA, 17110 bp, Homo sapiens
  Payload ID: 10597
  Gene Symbol: MUC4
  Gene Name: mucin 4, cell surface associated
  ENST ID: ENST00000463781
  CDS Start-End: 461-16699
tacagccccaaggtcgctccctctggggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155652 - DNA, 16245 bp, Homo sapiens
  Payload ID: 10597
  Gene Symbol: MUC4
  Gene Name: mucin 4, cell surface associated
  ENST ID: ENST00000480843
  CDS Start-End: 73-13449
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155653 - DNA, 16443 bp, Homo sapiens
  Payload ID: 10597
  Gene Symbol: MUC4
  Gene Name: mucin 4, cell surface associated
  ENST ID: ENST00000466475
  CDS Start-End: 73-13365
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155654 - DNA, 16075 bp, Homo sapiens
  Payload ID: 10597
  Gene Symbol: MUC4
  Gene Name: mucin 4, cell surface associated
  ENST ID: ENST00000479406
  CDS Start-End: 73-13365
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155655 - DNA, 16401 bp, Homo sapiens
  Payload ID: 10597
  Gene Symbol: MUC4
  Gene Name: mucin 4, cell surface associated
  ENST ID: ENST00000477756
  CDS Start-End: 73-13605
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155656 - DNA, 16562 bp, Homo sapiens
  Payload ID: 10597
  Gene Symbol: MUC4
  Gene Name: mucin 4, cell surface associated
  ENST ID: ENST00000478156
  CDS Start-End: 73-15285
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155657 - DNA, 16353 bp, Homo sapiens
  Payload ID: 10597
  Gene Symbol: MUC4
  Gene Name: mucin 4, cell surface associated
  ENST ID: ENST00000477086
  CDS Start-End: 73-13275
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155658 - DNA, 16273 bp, Homo sapiens
  Payload ID: 10597
  Gene Symbol: MUC4
  Gene Name: mucin 4, cell surface associated
  ENST ID: ENST00000475231
  CDS Start-End: 73-16155
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155659 - DNA, 16169 bp, Homo sapiens
  Payload ID: 10597
  Gene Symbol: MUC4
  Gene Name: mucin 4, cell surface associated
  ENST ID: ENST00000470451
  CDS Start-End: 73-13407
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155660 - DNA, 1812 bp, Homo sapiens
  Payload ID: 10597
  Gene Symbol: MUC4
  Gene Name: mucin 4, cell surface associated
  ENST ID: ENST00000618211
  CDS Start-End: 1-1812
ggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcc

SEQ ID NO: 155661 - DNA, 16352 bp, Homo sapiens
  Payload ID: 10597
  Gene Symbol: MUC4
  Gene Name: mucin 4, cell surface associated
  ENST ID: ENST00000617794
  CDS Start-End: 1-15945
tctctgcctccttccgcatgtggtcccagggtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtgacaccacccctcttcatgtcaccgacgcttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtcacaccacccctcttcctgtcaccgacgcttcctcagcatccacaggtcatgccacccctcttcctgtcaccagcacttcctcagcatccacaggtgacaccacccctcttcctgtcaccagcccttcctcagcatccacaggtcacgccacctctcttcctgtcaccgacacttcctcagtatccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtatccacaggtgacaccacgcctcttcctgtcaccgacacttcctcagcatccacaggtcacgccacccctcttcatgtcaccagcccttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtgacaccacgcctcttcctgtcactagcccttcctcagcatccacaggtcacgccacccctcttcctgtcaccgacacttcctcagcatacacaggtgacaccacctctcttcctgtcaccgacacttcctcatcatccacaggtcacgccacccctcttcatgtcaccagcccttcctcagcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacccctcttcctgtcaccgacgcttcctcggcatccaccggtcacgccacccctcttcctgtcaccagcctttcctcagtatccacaggtgacaccacccctcttcctgtcaccgacgcttcctcggcatccacaggtgacaccacgcctcttcctgtcaccatcccttcctcagcatcctcaggtcacaccacctctcttcctgtcaccgacacttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacacttcctcagcatccacaggtcaggccacccctcttcctgtcaccagcctttcctcagtatccacaggtgacaccatgcctcttcctgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtcaccgacacttcctcagtatccacaggtgacaccacgcctcttcctgtcactagcccttcctcagcatccacaggtgacaccacccctcttcctgtcaccgacgcttcctcagtatccacaggtcacaccacccctcttcctgtcaccgacacttcctcagcatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccagcccttcctcagcatccacaggtgacaccacccctcttcctgtcaccgacgcttcctcagcatccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccggcctttcctcagcttccacagatgacaccacccgtcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcaccgacgcttcctcagtatccacaggtcacgccacctctcttcttgtcaccgacgcttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtcatgccacccctcttcctgtcaccagcacttcctcagcatccacaggtgacaccacccctcttcctgtcaccagcccttcctcagcatctacaggtcacaccacccctctacctgtcaccgacactccctcagcatccacaggtgacaccacccctcttcctgtcaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctcc

SEQ ID NO: 155662 - DNA, 6550 bp, Homo sapiens
  Payload ID: 10597
  Gene Symbol: MUC4
  Gene Name: mucin 4, cell surface associated
  ENST ID: ENST00000617663
  CDS Start-End: 1-6432
ccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155663 - DNA, 3860 bp, Homo sapiens
  Payload ID: 10597
  Gene Symbol: MUC4
  Gene Name: mucin 4, cell surface associated
  ENST ID: ENST00000612476
  CDS Start-End: 1-3449
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155664 - DNA, 16568 bp, Homo sapiens
  Payload ID: 10597
  Gene Symbol: MUC4
  Gene Name: mucin 4, cell surface associated
  ENST ID: ENST00000621966
  CDS Start-End: 1-16157
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155665 - DNA, 16119 bp, Homo sapiens
  Payload ID: 10597
  Gene Symbol: MUC4
  Gene Name: mucin 4, cell surface associated
  ENST ID: ENST00000612796
  CDS Start-End: 1-16001
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155666 - DNA, 14907 bp, Homo sapiens
  Payload ID: 10597
  Gene Symbol: MUC4
  Gene Name: mucin 4, cell surface associated
  ENST ID: ENST00000614666
  CDS Start-End: 1-14907
ccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctcttt

SEQ ID NO: 155667 - DNA, 14907 bp, Homo sapiens; identical to SEQ ID NO: 155666
  Payload ID: 10597
  Gene Symbol: MUC4
  Gene Name: mucin 4, cell surface associated
  ENST ID: ENST00000615271
  CDS Start-End: 1-14907

SEQ ID NO: 155668 - DNA, 1827 bp, Homo sapiens
  Payload ID: 10597
  Gene Symbol: MUC4
  Gene Name: mucin 4, cell surface associated
  ENST ID: ENST00000613615
  CDS Start-End: 1-1827
tcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcc

SEQ ID NO: 155669 - DNA, 3860 bp, Homo sapiens
  Payload ID: 10597
  Gene Symbol: MUC4
  Gene Name: mucin 4, cell surface associated
  ENST ID: ENST00000619175
  CDS Start-End: 1-3449
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155670 - DNA, 6420 bp, Homo sapiens
  Payload ID: 10597
  Gene Symbol: MUC4
  Gene Name: mucin 4, cell surface associated
  ENST ID: ENST00000618077
  CDS Start-End: 1-6417
ccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaagg

SEQ ID NO: 155671 - DNA, 16568 bp, Homo sapiens
  Payload ID: 10597
  Gene Symbol: MUC4
  Gene Name: mucin 4, cell surface associated
  ENST ID: ENST00000617056
  CDS Start-End: 1-16157
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155672 - DNA, 16119 bp, Homo sapiens
  Payload ID: 10597
  Gene Symbol: MUC4
  Gene Name: mucin 4, cell surface associated
  ENST ID: ENST00000610962
  CDS Start-End: 1-16001
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155673 - DNA, 6420 bp, Homo sapiens
  Payload ID: 10597
  Gene Symbol: MUC4
  Gene Name: mucin 4, cell surface associated
  ENST ID: ENST00000612020
  CDS Start-End: 1-6417
ccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaagg

SEQ ID NO: 155674 - DNA, 3785 bp, Homo sapiens
  Payload ID: 10597
  Gene Symbol: MUC4
  Gene Name: mucin 4, cell surface associated
  ENST ID: ENST00000613841
  CDS Start-End: 1-503
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155675 - DNA, 6420 bp, Homo sapiens; identical to SEQ ID NO: 155673
  Payload ID: 10597
  Gene Symbol: MUC4
  Gene Name: mucin 4, cell surface associated
  ENST ID: ENST00000619402
  CDS Start-End: 1-6417

SEQ ID NO: 155676 - DNA, 1812 bp, Homo sapiens; identical to SEQ ID NO: 155660
  Payload ID: 10597
  Gene Symbol: MUC4
  Gene Name: mucin 4, cell surface associated
  ENST ID: ENST00000620934
  CDS Start-End: 1-1812

SEQ ID NO: 155677 - DNA, 16566 bp, Homo sapiens
  Payload ID: 10597
  Gene Symbol: MUC4
  Gene Name: mucin 4, cell surface associated
  ENST ID: ENST00000631334
  CDS Start-End: 1-16157
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155678 - DNA, 16631 bp, Homo sapiens
  Payload ID: 10597
  Gene Symbol: MUC4
  Gene Name: mucin 4, cell surface associated
  ENST ID: ENST00000631078
  CDS Start-End: 1-13181
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctatcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155679 - DNA, 3714 bp, Homo sapiens
  Payload ID: 10597
  Gene Symbol: MUC4
  Gene Name: mucin 4, cell surface associated
  ENST ID: ENST00000629775
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155680 - DNA, 3707 bp, Homo sapiens
  Payload ID: 10597
  Gene Symbol: MUC4
  Gene Name: mucin 4, cell surface associated
  ENST ID: ENST00000628456
  CDS Start-End: 1-3296
gagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155681 - DNA, 16409 bp, Homo sapiens
  Payload ID: 10597
  Gene Symbol: MUC4
  Gene Name: mucin 4, cell surface associated
  ENST ID: ENST00000625238
  CDS Start-End: 1-15134
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155682 - DNA, 22461 bp, Homo sapiens
  Payload ID: 10597
  Gene Symbol: MUC4
  Gene Name: mucin 4, cell surface associated
  ENST ID: ENST00000629163
  CDS Start-End: 73-19383
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155683 - DNA, 16332 bp, Homo sapiens
  Payload ID: 10597
  Gene Symbol: MUC4
  Gene Name: mucin 4, cell surface associated
  ENST ID: ENST00000629826
  CDS Start-End: 1-13121
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155684 - DNA, 16119 bp, Homo sapiens; identical to SEQ ID NO: 155672
  Payload ID: 10597
  Gene Symbol: MUC4
  Gene Name: mucin 4, cell surface associated
  ENST ID: ENST00000629154
  CDS Start-End: 1-16001

SEQ ID NO: 155685 - DNA, 22419 bp, Homo sapiens
  Payload ID: 10597
  Gene Symbol: MUC4
  Gene Name: mucin 4, cell surface associated
  ENST ID: ENST00000628818
  CDS Start-End: 73-19623
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155686 - DNA, 16493 bp, Homo sapiens
  Payload ID: 10597
  Gene Symbol: MUC4
  Gene Name: mucin 4, cell surface associated
  ENST ID: ENST00000628931
  CDS Start-End: 1-13211
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155687 - DNA, 3858 bp, Homo sapiens
  Payload ID: 10597
  Gene Symbol: MUC4
  Gene Name: mucin 4, cell surface associated
  ENST ID: ENST00000629001
  CDS Start-End: 1-3449
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155688 - DNA, 22580 bp, Homo sapiens
  Payload ID: 10597
  Gene Symbol: MUC4
  Gene Name: mucin 4, cell surface associated
  ENST ID: ENST00000627146
  CDS Start-End: 73-21303
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155689 - DNA, 16289 bp, Homo sapiens
  Payload ID: 10597
  Gene Symbol: MUC4
  Gene Name: mucin 4, cell surface associated
  ENST ID: ENST00000630127
  CDS Start-End: 1-13211
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155690 - DNA, 3804 bp, Homo sapiens
  Payload ID: 10597
  Gene Symbol: MUC4
  Gene Name: mucin 4, cell surface associated
  ENST ID: ENST00000627276
  CDS Start-End: 1-524
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155691 - DNA, 16091 bp, Homo sapiens
  Payload ID: 10597
  Gene Symbol: MUC4
  Gene Name: mucin 4, cell surface associated
  ENST ID: ENST00000628806
  CDS Start-End: 1-13295
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155692 - DNA, 16566 bp, Homo sapiens; identical to SEQ ID NO: 155677
  Payload ID: 10597
  Gene Symbol: MUC4
  Gene Name: mucin 4, cell surface associated
  ENST ID: ENST00000629947
  CDS Start-End: 1-16157

SEQ ID NO: 155693 - DNA, 16043 bp, Homo sapiens
  Payload ID: 10597
  Gene Symbol: MUC4
  Gene Name: mucin 4, cell surface associated
  ENST ID: ENST00000631351
  CDS Start-End: 1-13247
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155694 - DNA, 16015 bp, Homo sapiens
  Payload ID: 10597
  Gene Symbol: MUC4
  Gene Name: mucin 4, cell surface associated
  ENST ID: ENST00000629021
  CDS Start-End: 1-13253
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155695 - DNA, 16043 bp, Homo sapiens; identical to SEQ ID NO: 155693
  Payload ID: 10597
  Gene Symbol: MUC4
  Gene Name: mucin 4, cell surface associated
  ENST ID: ENST00000626318
  CDS Start-End: 1-13247

SEQ ID NO: 155696 - DNA, 3942 bp, Homo sapiens
  Payload ID: 10597
  Gene Symbol: MUC4
  Gene Name: mucin 4, cell surface associated
  ENST ID: ENST00000630176
  CDS Start-End: 1-494
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctatcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155697 - DNA, 16122 bp, Homo sapiens
  Payload ID: 10597
  Gene Symbol: MUC4
  Gene Name: mucin 4, cell surface associated
  ENST ID: ENST00000627791
  CDS Start-End: 1-16004
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155698 - DNA, 16566 bp, Homo sapiens; identical to SEQ ID NO: 155677
  Payload ID: 10597
  Gene Symbol: MUC4
  Gene Name: mucin 4, cell surface associated
  ENST ID: ENST00000631008
  CDS Start-End: 1-16157

SEQ ID NO: 155699 - DNA, 16015 bp, Homo sapiens
  Payload ID: 10597
  Gene Symbol: MUC4
  Gene Name: mucin 4, cell surface associated
  ENST ID: ENST00000628062
  CDS Start-End: 1-13253
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155700 - DNA, 16406 bp, Homo sapiens
  Payload ID: 10597
  Gene Symbol: MUC4
  Gene Name: mucin 4, cell surface associated
  ENST ID: ENST00000626664
  CDS Start-End: 1-15131
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155701 - DNA, 16015 bp, Homo sapiens; identical to SEQ ID NO: 155694
  Payload ID: 10597
  Gene Symbol: MUC4
  Gene Name: mucin 4, cell surface associated
  ENST ID: ENST00000627334
  CDS Start-End: 1-13253

SEQ ID NO: 155702 - DNA, 16043 bp, Homo sapiens
  Payload ID: 10597
  Gene Symbol: MUC4
  Gene Name: mucin 4, cell surface associated
  ENST ID: ENST00000627236
  CDS Start-End: 1-13247
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155703 - DNA, 3804 bp, Homo sapiens; identical to SEQ ID NO: 155690
  Payload ID: 10597
  Gene Symbol: MUC4
  Gene Name: mucin 4, cell surface associated
  ENST ID: ENST00000627153
  CDS Start-End: 1-524

SEQ ID NO: 155704 - DNA, 16091 bp, Homo sapiens
  Payload ID: 10597
  Gene Symbol: MUC4
  Gene Name: mucin 4, cell surface associated
  ENST ID: ENST00000630081
  CDS Start-End: 1-13295
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155705 - DNA, 3944 bp, Homo sapiens
  Payload ID: 10597
  Gene Symbol: MUC4
  Gene Name: mucin 4, cell surface associated
  ENST ID: ENST00000627577
  CDS Start-End: 1-494
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctatcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155706 - DNA, 3695 bp, Homo sapiens
  Payload ID: 10597
  Gene Symbol: MUC4
  Gene Name: mucin 4, cell surface associated
  ENST ID: ENST00000627017
  CDS Start-End: 1-413
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155707 - DNA, 16250 bp, Homo sapiens
  Payload ID: 10597
  Gene Symbol: MUC4
  Gene Name: mucin 4, cell surface associated
  ENST ID: ENST00000627411
  CDS Start-End: 1-13454
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155708 - DNA, 22093 bp, Homo sapiens
  Payload ID: 10597
  Gene Symbol: MUC4
  Gene Name: mucin 4, cell surface associated
  ENST ID: ENST00000630966
  CDS Start-End: 73-19383
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155709 - DNA, 3923 bp, Homo sapiens
  Payload ID: 10597
  Gene Symbol: MUC4
  Gene Name: mucin 4, cell surface associated
  ENST ID: ENST00000630917
  CDS Start-End: 1-473
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctatcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155710 - DNA, 16408 bp, Homo sapiens
  Payload ID: 10597
  Gene Symbol: MUC4
  Gene Name: mucin 4, cell surface associated
  ENST ID: ENST00000626427
  CDS Start-End: 1-15131
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155711 - DNA, 16403 bp, Homo sapiens
  Payload ID: 10597
  Gene Symbol: MUC4
  Gene Name: mucin 4, cell surface associated
  ENST ID: ENST00000629873
  CDS Start-End: 1-13121
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155712 - DNA, 3645 bp, Homo sapiens
  Payload ID: 10597
  Gene Symbol: MUC4
  Gene Name: mucin 4, cell surface associated
  ENST ID: ENST00000629929
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155713 - DNA, 16119 bp, Homo sapiens; identical to SEQ ID NO: 155672
  Payload ID: 10597
  Gene Symbol: MUC4
  Gene Name: mucin 4, cell surface associated
  ENST ID: ENST00000627295
  CDS Start-End: 1-16001

SEQ ID NO: 155714 - DNA, 16289 bp, Homo sapiens; identical to SEQ ID NO: 155689
  Payload ID: 10597
  Gene Symbol: MUC4
  Gene Name: mucin 4, cell surface associated
  ENST ID: ENST00000628970
  CDS Start-End: 1-13211

SEQ ID NO: 155715 - DNA, 3643 bp, Homo sapiens
  Payload ID: 10597
  Gene Symbol: MUC4
  Gene Name: mucin 4, cell surface associated
  ENST ID: ENST00000627007
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155716 - DNA, 15921 bp, Homo sapiens
  Payload ID: 10597
  Gene Symbol: MUC4
  Gene Name: mucin 4, cell surface associated
  ENST ID: ENST00000625407
  CDS Start-End: 1-13211
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155717 - DNA, 15921 bp, Homo sapiens
  Payload ID: 10597
  Gene Symbol: MUC4
  Gene Name: mucin 4, cell surface associated
  ENST ID: ENST00000627476
  CDS Start-End: 1-13211
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155718 - DNA, 22291 bp, Homo sapiens
  Payload ID: 10597
  Gene Symbol: MUC4
  Gene Name: mucin 4, cell surface associated
  ENST ID: ENST00000629882
  CDS Start-End: 73-22173
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155719 - DNA, 16569 bp, Homo sapiens
  Payload ID: 10597
  Gene Symbol: MUC4
  Gene Name: mucin 4, cell surface associated
  ENST ID: ENST00000626248
  CDS Start-End: 1-16160
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155720 - DNA, 3693 bp, Homo sapiens
  Payload ID: 10597
  Gene Symbol: MUC4
  Gene Name: mucin 4, cell surface associated
  ENST ID: ENST00000630769
  CDS Start-End: 1-413
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155721 - DNA, 22215 bp, Homo sapiens
  Payload ID: 10597
  Gene Symbol: MUC4
  Gene Name: mucin 4, cell surface associated
  ENST ID: ENST00000627165
  CDS Start-End: 73-19419
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155722 - DNA, 16202 bp, Homo sapiens
  Payload ID: 10597
  Gene Symbol: MUC4
  Gene Name: mucin 4, cell surface associated
  ENST ID: ENST00000628330
  CDS Start-End: 1-13124
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155723 - DNA, 22263 bp, Homo sapiens
  Payload ID: 10597
  Gene Symbol: MUC4
  Gene Name: mucin 4, cell surface associated
  ENST ID: ENST00000631201
  CDS Start-End: 73-19467
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155724 - DNA, 3756 bp, Homo sapiens
  Payload ID: 10597
  Gene Symbol: MUC4
  Gene Name: mucin 4, cell surface associated
  ENST ID: ENST00000629801
  CDS Start-End: 1-413
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155725 - DNA, 16247 bp, Homo sapiens
  Payload ID: 10597
  Gene Symbol: MUC4
  Gene Name: mucin 4, cell surface associated
  ENST ID: ENST00000629006
  CDS Start-End: 1-13451
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155726 - DNA, 3858 bp, Homo sapiens
  Payload ID: 10597
  Gene Symbol: MUC4
  Gene Name: mucin 4, cell surface associated
  ENST ID: ENST00000631127
  CDS Start-End: 1-3449
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155727 - DNA, 3622 bp, Homo sapiens
  Payload ID: 10597
  Gene Symbol: MUC4
  Gene Name: mucin 4, cell surface associated
  ENST ID: ENST00000627062
  CDS Start-End: 1-413
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155728 - DNA, 3716 bp, Homo sapiens
  Payload ID: 10597
  Gene Symbol: MUC4
  Gene Name: mucin 4, cell surface associated
  ENST ID: ENST00000631180
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155729 - DNA, 16289 bp, Homo sapiens; identical to SEQ ID NO: 155689
  Payload ID: 10597
  Gene Symbol: MUC4
  Gene Name: mucin 4, cell surface associated
  ENST ID: ENST00000626905
  CDS Start-End: 1-13211

SEQ ID NO: 155730 - DNA, 3643 bp, Homo sapiens; identical to SEQ ID NO: 155715
  Payload ID: 10597
  Gene Symbol: MUC4
  Gene Name: mucin 4, cell surface associated
  ENST ID: ENST00000628366
  CDS Start-End: 1-434

SEQ ID NO: 155731 - DNA, 16408 bp, Homo sapiens
  Payload ID: 10597
  Gene Symbol: MUC4
  Gene Name: mucin 4, cell surface associated
  ENST ID: ENST00000628987
  CDS Start-End: 1-15131
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155732 - DNA, 16247 bp, Homo sapiens
  Payload ID: 10597
  Gene Symbol: MUC4
  Gene Name: mucin 4, cell surface associated
  ENST ID: ENST00000627203
  CDS Start-End: 1-13451
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155733 - DNA, 22371 bp, Homo sapiens
  Payload ID: 10597
  Gene Symbol: MUC4
  Gene Name: mucin 4, cell surface associated
  ENST ID: ENST00000625840
  CDS Start-End: 73-19293
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155734 - DNA, 16406 bp, Homo sapiens; identical to SEQ ID NO: 155700
  Payload ID: 10597
  Gene Symbol: MUC4
  Gene Name: mucin 4, cell surface associated
  ENST ID: ENST00000628045
  CDS Start-End: 1-15131

SEQ ID NO: 155735 - DNA, 3942 bp, Homo sapiens; identical to SEQ ID NO: 155696
  Payload ID: 10597
  Gene Symbol: MUC4
  Gene Name: mucin 4, cell surface associated
  ENST ID: ENST00000629790
  CDS Start-End: 1-494

SEQ ID NO: 155736 - DNA, 16199 bp, Homo sapiens
  Payload ID: 10597
  Gene Symbol: MUC4
  Gene Name: mucin 4, cell surface associated
  ENST ID: ENST00000627391
  CDS Start-End: 1-13121
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155737 - DNA, 3624 bp, Homo sapiens
  Payload ID: 10597
  Gene Symbol: MUC4
  Gene Name: mucin 4, cell surface associated
  ENST ID: ENST00000627218
  CDS Start-End: 1-413
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155738 - DNA, 3829 bp, Homo sapiens
  Payload ID: 10597
  Gene Symbol: MUC4
  Gene Name: mucin 4, cell surface associated
  ENST ID: ENST00000626364
  CDS Start-End: 41-3418
ggagcttccccagggagccagggggacttttgccgcagccatgaagggggcacgctggaggagggtcccctgggtgtccctgagctgcctgtgtctctgcctccttccgcatgtggtcccaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155739 - DNA, 3806 bp, Homo sapiens
  Payload ID: 10597
  Gene Symbol: MUC4
  Gene Name: mucin 4, cell surface associated
  ENST ID: ENST00000630616
  CDS Start-End: 1-524
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155740 - DNA, 16015 bp, Homo sapiens; identical to SEQ ID NO: 155694
  Payload ID: 10597
  Gene Symbol: MUC4
  Gene Name: mucin 4, cell surface associated
  ENST ID: ENST00000626878
  CDS Start-End: 1-13253

SEQ ID NO: 155741 - DNA, 16199 bp, Homo sapiens
  Payload ID: 10597
  Gene Symbol: MUC4
  Gene Name: mucin 4, cell surface associated
  ENST ID: ENST00000629793
  CDS Start-End: 1-13121
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155742 - DNA, 3714 bp, Homo sapiens; identical to SEQ ID NO: 155679
  Payload ID: 10597
  Gene Symbol: MUC4
  Gene Name: mucin 4, cell surface associated
  ENST ID: ENST00000629031
  CDS Start-End: 1-434

SEQ ID NO: 155743 - DNA, 16043 bp, Homo sapiens; identical to SEQ ID NO: 155693
  Payload ID: 10597
  Gene Symbol: MUC4
  Gene Name: mucin 4, cell surface associated
  ENST ID: ENST00000625421
  CDS Start-End: 1-13247

SEQ ID NO: 155744 - DNA, 22187 bp, Homo sapiens
  Payload ID: 10597
  Gene Symbol: MUC4
  Gene Name: mucin 4, cell surface associated
  ENST ID: ENST00000627603
  CDS Start-End: 73-19425
gtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155745 - DNA, 16091 bp, Homo sapiens; identical to SEQ ID NO: 155691
  Payload ID: 10597
  Gene Symbol: MUC4
  Gene Name: mucin 4, cell surface associated
  ENST ID: ENST00000631279
  CDS Start-End: 1-13295

SEQ ID NO: 155746 - DNA, 16247 bp, Homo sapiens; identical to SEQ ID NO: 155732
  Payload ID: 10597
  Gene Symbol: MUC4
  Gene Name: mucin 4, cell surface associated
  ENST ID: ENST00000626727
  CDS Start-End: 1-13451

SEQ ID NO: 155747 - DNA, 3705 bp, Homo sapiens
  Payload ID: 10597
  Gene Symbol: MUC4
  Gene Name: mucin 4, cell surface associated
  ENST ID: ENST00000630643
  CDS Start-End: 1-3296
gagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155748 - DNA, 16199 bp, Homo sapiens; identical to SEQ ID NO: 155736
  Payload ID: 10597
  Gene Symbol: MUC4
  Gene Name: mucin 4, cell surface associated
  ENST ID: ENST00000631097
  CDS Start-End: 1-13121

SEQ ID NO: 155749 - DNA, 3775 bp, Homo sapiens
  Payload ID: 10597
  Gene Symbol: MUC4
  Gene Name: mucin 4, cell surface associated
  ENST ID: ENST00000631081
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155750 - DNA, 16094 bp, Homo sapiens
  Payload ID: 10597
  Gene Symbol: MUC4
  Gene Name: mucin 4, cell surface associated
  ENST ID: ENST00000630579
  CDS Start-End: 1-13298
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155751 - DNA, 16091 bp, Homo sapiens; identical to SEQ ID NO: 155691
  Payload ID: 10597
  Gene Symbol: MUC4
  Gene Name: mucin 4, cell surface associated
  ENST ID: ENST00000630459
  CDS Start-End: 1-13295

SEQ ID NO: 155752 - DNA, 3775 bp, Homo sapiens; identical to SEQ ID NO: 155749
  Payload ID: 10597
  Gene Symbol: MUC4
  Gene Name: mucin 4, cell surface associated
  ENST ID: ENST00000626390
  CDS Start-End: 1-434

SEQ ID NO: 155753 - DNA, 16289 bp, Homo sapiens
  Payload ID: 10597
  Gene Symbol: MUC4
  Gene Name: mucin 4, cell surface associated
  ENST ID: ENST00000630037
  CDS Start-End: 1-13211
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155754 - DNA, 16199 bp, Homo sapiens; identical to SEQ ID NO: 155736
  Payload ID: 10597
  Gene Symbol: MUC4
  Gene Name: mucin 4, cell surface associated
  ENST ID: ENST00000630325
  CDS Start-End: 1-13121

SEQ ID NO: 155755 - DNA, 16464 bp, Homo sapiens
  Payload ID: 10597
  Gene Symbol: MUC4
  Gene Name: mucin 4, cell surface associated
  ENST ID: ENST00000626113
  CDS Start-End: 1-13121
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155756 - DNA, 23128 bp, Homo sapiens
  Payload ID: 10597
  Gene Symbol: MUC4
  Gene Name: mucin 4, cell surface associated
  ENST ID: ENST00000626947
  CDS Start-End: 461-22717
tacagccccaaggtcgctccctctggggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactcctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagtaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacaggggcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccagtgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagaatccacaggtcacgccacccctcttcctgtcaccagcccttcctcagtatccacaggtcacaccacccctcttcctgtcaccgacacttcctcagaatccacaggtcatgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccggcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccacccctcttcctgtcaccagcccttcctcagcatcctcaggtcacaccacccctcttcctgtcaccgacgcttcctcagtatccacaggtgacaccacccctcttcctgtcaccagcccttcctcagcatcctcaggtcacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacaccacctctcttcatgtcaccagcccttcctcagcatccacaggtcacgccacctctcttcctgtcaccgacacttcctcagtatccacaggtcatgccacccctcttcatgtcaccagcccttcctcagcatccacaggtgacaccacccctcttcctgtcaccgacacttactcagcatccacaggtcaggccacccctcttcctgtcaccgacacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgttaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccgacacttcctcagcatacacaggtgacaccacctctcttcctgtcaccgacacttcctcatcatccacaggtgacaccacccctcttcttgtcaccgagacttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagcatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccacaggtcacgccacccctcttcctctcaccagcctttcctcagtatccacaggtgacaccacgactcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcaccgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacagacacttcctcagcatccacaggtcaggccacccctcttcctgtcaccagcctttcctcagtatccacaggtgacaccacccctcttcttgtcaccaacacttcctcagtatccagaggtcacgccacctctcttcctgtcaccatcccttcctcatcatcctcaggtcacaccacccctcttcctgtcaccagcacttcctcagtatctacaggtcacgtcacccctcttcctgtcaccagcacttcctcagcatccacaggtcacgccacctctcttcctgtcaccgacacttcctcagtatccacaggtcacgccacctctcttcctgtcaccgacacttcctcagtatccacaggtcacgccacccctcttcctgtcaccgacgcttcctcagtgtccacaggtcacgccacgcctcttcctgtcaccgacgcttcctcagcatccacaggtgacaccacccctcttcctgtcaccaacacttcctcagcatccacaggtcaggccacccctcttcctgtcaccagcctttcctcagtatccacaggtgacaccatgcctcttcctgtcactagcccttcctcagcatccacaggtcacgccacccctcttcctgttaccggcctttcctcagcttccacaggtgacaccacccctcttcctgtcactgacacttcctcagcatccacaggtcacgtcacccctcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacccctcttcatgtcactgatgcttcctcagcatccacaggtcaggccacccttcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcacggacgcttcctcagtgtccacaggtcacgccacctctcttcctgtaaccatccgttcctcaggttccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacactacctcagcatccaaaggtgacaccacccctcttcctgtcaccagcccttcctcagcatctacaggtcacaccacccctcttcctgtcaccgacacttcctcagcatccacaggtgacaccacccctcttcctgtcaccagcccttcctcagcatccacaggtcacgccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacctctcttcctgtcaccagcacttcctcagcatccaccggtcacgccacccctcttcctgtcaccgacaattcctcagtatccacaggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttccttagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcagtatctacaggtcacgtcacccctcttcatgtcaccagcccttcctcagcatccacaggtcacgccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155757 - DNA, 16247 bp, Homo sapiens; identical to SEQ ID NO: 155732
  Payload ID: 10597
  Gene Symbol: MUC4
  Gene Name: mucin 4, cell surface associated
  ENST ID: ENST00000625520
  CDS Start-End: 1-13451

SEQ ID NO: 155758 - DNA, 16292 bp, Homo sapiens
  Payload ID: 10597
  Gene Symbol: MUC4
  Gene Name: mucin 4, cell surface associated
  ENST ID: ENST00000631360
  CDS Start-End: 1-13214
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155759 - DNA, 3707 bp, Homo sapiens
  Payload ID: 10597
  Gene Symbol: MUC4
  Gene Name: mucin 4, cell surface associated
  ENST ID: ENST00000631146
  CDS Start-End: 1-3296
gagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155760 - DNA, 3777 bp, Homo sapiens
  Payload ID: 10597
  Gene Symbol: MUC4
  Gene Name: mucin 4, cell surface associated
  ENST ID: ENST00000630258
  CDS Start-End: 1-434
ctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaa

SEQ ID NO: 155761 - DNA, 15924 bp, Homo sapiens
  Payload ID: 10597
  Gene Symbol: MUC4
  Gene Name: mucin 4, cell surface associated
  ENST ID: ENST00000628685
  CDS Start-End: 1-13214
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155762 - DNA, 15921 bp, Homo sapiens; identical to SEQ ID NO: 155717
  Payload ID: 10597
  Gene Symbol: MUC4
  Gene Name: mucin 4, cell surface associated
  ENST ID: ENST00000625430
  CDS Start-End: 1-13211

SEQ ID NO: 155763 - DNA, 3705 bp, Homo sapiens
  Payload ID: 10597
  Gene Symbol: MUC4
  Gene Name: mucin 4, cell surface associated
  ENST ID: ENST00000625485
  CDS Start-End: 1-3296
gagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155764 - DNA, 16046 bp, Homo sapiens
  Payload ID: 10597
  Gene Symbol: MUC4
  Gene Name: mucin 4, cell surface associated
  ENST ID: ENST00000629594
  CDS Start-End: 1-13250
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155765 - DNA, 15921 bp, Homo sapiens; identical to SEQ ID NO: 155717
  Payload ID: 10597
  Gene Symbol: MUC4
  Gene Name: mucin 4, cell surface associated
  ENST ID: ENST00000628289
  CDS Start-End: 1-13211

SEQ ID NO: 155766 - DNA, 3982 bp, Homo sapiens
  Payload ID: 10597
  Gene Symbol: MUC4
  Gene Name: mucin 4, cell surface associated
  ENST ID: ENST00000626242
  CDS Start-End: 41-3571
ggagcttccccagggagccagggggacttttgccgcagccatgaagggggcacgctggaggagggtcccctgggtgtccctgagctgcctgtgtctctgcctccttccgcatgtggtcccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaa

SEQ ID NO: 155767 - DNA, 3754 bp, Homo sapiens
  Payload ID: 10597
  Gene Symbol: MUC4
  Gene Name: mucin 4, cell surface associated
  ENST ID: ENST00000631069
  CDS Start-End: 1-413
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155768 - DNA, 16018 bp, Homo sapiens
  Payload ID: 10597
  Gene Symbol: MUC4
  Gene Name: mucin 4, cell surface associated
  ENST ID: ENST00000630183
  CDS Start-End: 1-13256
gaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccacaggtgacaccacccctcttcctgtcaccgacacttcctcagcatccacaggtcacgccccccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcttcatgtcaccgatgcttcctcagtatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccacccctcttcctgtcaccgacacttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccagcacttcctcagcatccaccggtcacgccacccctcttcctgtcaccgacaattcctcagtatccacaggtcatgccacccctcttcctgtcaccggcctttcctcagctaccacagatgacaccacccgtcttcctgtcaccgacgtgtcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcctcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacctctcttcctgtcaccgacgcttcctcagtgtccacaggtcacgccacctctcttcctgtcaccatcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatcatccactggtgacaccacgccgcttcctgtcactgatacttcctcagcatccacaggtcaggacacccctcttcctgtcaccagccttttctcagtatccacaggtgacaccacgcctcttcctgtcactagcccttcctcagcatccacaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacaccacccctcttcctgtcaccagcccttcctcagcatccacaggtgacaccacccctcttcctgtcaccgacacttcctcagtatccacaggtcacgccacctctcttcctgtcactgacacttcctcagcatccacaggtcacgccacctctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgatgcttcctcagtgtccacaggtcacgccacctctcttcctgtcaccagcctttcctcagtatccacaggtgacaccacccctcttcctgtcactagcccttcctcagcatccacaggtcacgccacccctcttcatgtcaccagcccttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagcccttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccaccggtcacgccacccctcttcctgttaccgacacttccgcagcatccacaggtcacgccacccctcttcctgtcaccagcacttcctcagcatccacaggtgacaccacccctcttcctgtcaccgacacttcctcagcatccacaggtcatgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgtccacaggtcacgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatccacaggtcacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggacacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagcatccacaggtgacaccacccctcttcctgtcaccgacgcttcctcggcatccacaggtcaggccacccctcttcctgtcaccagcctttcctcagtatcaacaggtgacaccacgcctcttcctgtcaccatcccttcctcagcatcctcaggtcacaccacctctcttcctgtcagcgacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccaacacttcctcagtatccacaggtcacgccacctctcttcctgtcaccatcccttcctcatcatcctcaggtcacaccacccctcttcctgtcaccagcacttcctcagtatctacaggtcacgtcacccctcttcatgtcaccagcccttcctcatcatccacaggtcaggccacccctcttcctgtcaccagcacttcctcatcatccacaggtcaggccacccctcttcctgtcaccagcacttcctcagcatccacaggtcacgccacccctcttcctgtcaccgacgcttcctcagtgtccacaggtcacgccacgcctcttcctgtcaccgacacttcctcagcatccacaggtgacaccacccctcttcctgtcaccgacacttcctcagcatccacaggtcaggccacccctcttcctgtcaccagcctttcctcagtatccacaggtcacgccacccctcttgctgtcagcagtgctacctcagcttccacagtatcctcggactcccctctgaagatggaaacatcaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacgcttcacaggccgggaccctgtggccctggtggctccgttctgggacgatgctgacttctccactggtcgggggaccacattttatcagagcaacacctaccaagccatcctctccacggacgggagcaggtcctatgccctgtttctctaccagagcggtgggatgcagtgggacgtggcccagcgctcagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattctt

SEQ ID NO: 155769 - DNA, 3705 bp, Homo sapiens; identical to SEQ ID NO: 155747
  Payload ID: 10597
  Gene Symbol: MUC4
  Gene Name: mucin 4, cell surface associated
  ENST ID: ENST00000626305
  CDS Start-End: 1-3296

SEQ ID NO: 155770 - DNA, 3783 bp, Homo sapiens
  Payload ID: 10597
  Gene Symbol: MUC4
  Gene Name: mucin 4, cell surface associated
  ENST ID: ENST00000626164
  CDS Start-End: 1-503
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155771 - DNA, 3921 bp, Homo sapiens
  Payload ID: 10597
  Gene Symbol: MUC4
  Gene Name: mucin 4, cell surface associated
  ENST ID: ENST00000629076
  CDS Start-End: 1-473
gaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggctgtagggggtctgtcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaa

SEQ ID NO: 155772 - DNA, 17448 bp, Homo sapiens
  Payload ID: 10598
  Gene Symbol: MUC5AC
  Gene Name: mucin 5AC, oligomeric mucus/gel-forming
  Uniprot ID: P98088
  ENST ID: ENST00000621226
  CDS Start-End: 48-17012
ctcagaggctgctgagggacagggcactcttccccgccgtccacacaatgagtgttggccggaggaagctggccctgctctgggccctggctctcgctctggcctgcacccggcatacaggccatgcccaggatggctcctccgaatccagctacaagcaccaccctgccctctctcctatcgcccgggggcccagcggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggaggccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggaccagtgtcaggaccctgtccctgaacccccgaggaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgcgcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggaggttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccggggacacaggggctggctgtcagaagagctgccacacactggacatgacctgttacagcccccagtgtgtgcctggctgcgtgtgccccgacgggctggtggcggacggcgagggcggctgcatcactgcggaggactgcccctgcgtgcacaatgaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacacgctggtgcagaaccactgtggcgggaaagacagcacccaggactcctttcgtgttgtcaccgagaacgtcccctgcggcaccacagggaccacctgctccaaggccatcaagattttcctggggggcttcgagctgaagctaagccatgggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggccgcctacgcccaggcctgccatgaagtaggcctgtgtgtgtcctggcggaccccgagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcactgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagctgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctaccctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacactagtcaccagaaactgtcatccccggtgcacctggacaaagtggttcgacgtggacttcccgtcccccggaccccatggtggagacaaggaaacctacaacaacatcatcaggagtggggaaaaaatctgccgccgacctgaggagatcaccaggctccagtgccgagccaagagccacccagaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccagaggctgccacatgacctccacacctggctccacctctagcagtccagcccagaccactccttcaacaacctccaagaccactgaaacccaggcctcaggctcctcagcccccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggattgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagaccgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaacgtggttcgacgtggacttcccgtcccccggaccccatggtggagacaaggaaacctacaacaacatcatcaggagtggggaaaaaatctgccgccgacctgaggagatcaccaggctccagtgccgagccaagagccacccagaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagtacaacctatgcccatacaaccagcacaacctctgctcctacagccagaacaacctctgctcctacaaccagaacaacctctgcctctccagccagcacaacctctggtcctggaaatactcccagccctgttcctaccaccagcacaatctctgctcctacaactagcataacctctgcccctacaaccagcacaacctctgcccctacaagcagcacaacctctggtcctggaactactcccagccctgttcctaccaccagcataacctctgcccctacaaccagcacaacctctgctcctacaaccagcacaacctctgcccgtacaagcagcacaacctctgccactaccaccagcagaatctctggtcctgaaactactcccagccctgttcctaccaccagcacaacctctgccactacaaccagcacaacctcagctcctacaaccagcacaacctctgcccctacaagcagcacaacctccagtccacagaccagcacaacctcggctcctacaaccagcacaacttctggtcctggaactaccccaagccctgttcccacgaccagcacaacctctgcccctacaacaagaacaacttctgctcctaaaagcagcacaacctctgccgctacaaccagcacaacctctggtcctgaaactactcctagacctgttcctaccaccagcacaacctcttctcctacaaccagcacaacctctgctcctacaaccagcacaacctctgcttctacaaccagcacaacctctggtgctggaactactcccagccctgttcccaccaccagcacaacctctgctcctacaaccagcacaacctctgcccctataagcagcacaacctctgccactacaaccagcacaacctctggtcctggaactactcccagccctgttcctaccacgagcacaacctctgctcctacaaccagcacaacctctggtcctggaactactcccagtgctgttcccaccaccagcataacctctgcacctacaaccagcacaaactctgcccctataagcagcacaacctctgccactacaaccagcagaatctctggtcctgaaactactcccagccctgttcctaccgccagcacaacctctgcttctacaactagcacaacctctggtcctggaactactcccagccctgttcctaccaccagcacaatctctgttcctaccaccagcacaacttctgcttctacaaccagcacaacctctgcttctacaaccagcacaacctctggtcctggaactactcccagccctgttcccaccaccagcacaacctctgctcccacaacaagcacaacctctgcccctacaaccagcacaatctcggccccaacaaccagcacaacctctgccactacaaccagcacgacctctgctcctacacccagaagaacctcagcccctacaaccagcacaatctctgcctctaccaccagcacaacctctgcgactacaaccagcacaacctctgctactacaaccagcacaatctctgcccctacaaccagcacaactttgtctcctacaaccagcacaacctctactactataaccagcacaacttctgcccctataagcagcacaacttccacaccacagaccagcacaacttcggctcctacaaccagcacaacttctggtcctggaactacttcaagccctgttcccaccaccagcacaacctctgcccctacaaccagcacaacctctgcccctacaaccagaacaacctctgtccctacaagcagcacaacctccactgctacaaccagcacaacctctggccctggaactactcccagccctgttcccaccaccagtacaacctctgctcctacaaccagaacaacctctgctcctacaaccagcacaacctctgcccctacaaccagcacaacctctgcccctacaagcagcacaacctcagctactacaaccagcacaatctctgttcctacaaccagcacaacttctgttcctggaactactcccagccctgttcctaccaccagcacaatctctgttcctaccaccagcacaacttctgcttctacaaccagcacaacctctggtcctggaactactcccagccctgttcccaccaccagcacaacctctgctcccacaacaagcacaacctctgcccctacaaccagcacaatctcggccccaacaaccagcacaccctctgcccctacaaccagcacaaccttagctcctacaaccagcacaacctctgcccctacaaccagcacaacctctacccctacaagcagcacaacctcctctccacagaccagcacaacctcggcttctaccaccagcataacttctggtcctggaactaccccaagccctgttcccaccaccagcacaacctctgctcctacaaccagcacaacctctgccgctacaaccagcacaatctcggccccaacaaccagcacaacgtctgctcctacaaccagcacaacctctgcctctacagccagcaaaacctctggtcttggaactactcccagccctattcctaccaccagcacaacctctcctcctacaaccagcacaacttctgcctctacagccagcaaaacctctggtcctggaaccactcccagccctgttcccaccaccagcacaatctttgctcctagaaccagcaccacttctgcctctacaaccagcacaacccctggtcctggaaccactcccagccccgttcccaccaccagcacagcctctgtttcaaagaccagcacaagccatgtttccatatccaagacaacccactcccaaccagtcaccagagactgtcatctccggtgcacctggaccaagtggtttgacatagacttcccatcccctggaccccacggcggggacaaggaaacctacaacaacatcatcaggagtggggaaaaaatctgccgccgacctgaggagatcaccaggctccagtgccgagccgagagccacccggaggtgagcattgaacacctgggccaggtggtgcagtgcagccgtgaagagggcctggtgtgccggaaccaggaccagcagggacccttcaagatgtgcctcaactacgaggtgcgtgtgctctgctgcgagacccctaaaggttgccccgtgacctccacacctgtgacagctcctagcacccctagtgggagagccaccagcccaactcagagcacttcctcttggcagaaatccaggacaaccactttggtgacaaccagcacaacctccactccacagaccagcacaacctctgctcctacaaccagcacaacctctgctcccacaaccagcacaacttctgcccctacaaccagcacaacctccactccacagaccagcatatcctctgcccctacaagcagcacaacctcggctcctacaagcagcacaatctctgctcgtacaaccagcataatctctgcccctacaaccagcacaacctcttcccctacaaccagcacaacctctgctactacaaccagcacaacctctgcccctacaagcagcacaacctccactccacagaccagcaaaacctcagctgctacaagcagcacaacctccggttctggaactactcccagccctgttaccaccaccagcacagcctctgtttcaaagaccagcacaagccatgtttctgtatccaagacaacccactcccaaccagtcaccagagactgtcatccccggtgcacctggaccaaatggtttgatgtggactttccatcccctggaccccacggtggggacaaggaaacctacaacaacatcatcaggagtggggaaaaaatctgccgccgacctgaggagatcaccaggctccagtgccgagccaagagccacccggaggtgagcatcgaacacctgggccaggtggtgcagtgcagccgcgaagagggcctggtgtgccggaaccaggaccagcagggacccttcaagatgtgcctcaactacgaggtgcgtgtgctttgctgcgagacccccaaaggctgccccgtgacctccacatctgtgacagctcctagcacccctagtgggagagccaccagcccaactcagagcacctcctcttggcagaaatccaggacaaccactttggtgacaagcagcataacctccactacacagaccagcacaacctctgcccctacaactagcacaacccctgcttctatacccagcacaacctctgccccaacaaccagcacaacctctgctcccacaacgagcacaacttctgcccctacaaccagcacaacctccactccacagaccaccacatcctctgcccctacaagcagcacaacctcggctcctaccaccagcacaatctctgcccctacaaccagcacaatctctgcccctacaaccagcacaacctctgctcccacagccagcacaacgtcagctcctacgagcacttcctcggctcctacaaccaacacaacctctgcccctacaactagcactacctctgctcccataaccagcacaatctctgcccctacaaccagcacaacctccactccacagaccagcacaatctcttcccctacaaccagcacaacctccactccgcagaccagcacaacctcttcccctacaactagcacaacctcagctcctacaaccagcacaacttctgcccctacaaccagcacaacctccactccacagaccagcatatcctctgcccctacaagcagcacaacctctgctcctacagccagcacaatctctgcccctacaaccagcacaacctctttccatacaaccagcacaacctctccccctacaagcagcacaagctccactccacagaccagcaaaacctcagctgctacaagcagcacaacctccggttctggaactactcccagccccgttcccaccaccagcacagcctctgtttcaaagaccagcacaagccatgtttctgtatccaagacaacccactcccaaccagtcaccagagactgtcatccccggtgcacctggaccaagtggtttgacgtggactttccatcccctggaccccacggtggggacaaggaaacctacaacaacatcatcaggagtggggaaaaaatctgccgccgacctgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacttcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgcccctacaaccagcacgacctcagctcctacacacagaacgacttctggtcctacaaccagcacaaccttggctcctacaaccagcacaacctctgctccaacaaccagcacaaactctgctcctacaaccagcacaatctctgcctctacaaccagcacaatctctgcccctacaaccagcacaatctcttcccctacaagcagcacaacctccactccacagaccagcaaaacctcagctgctacaagcagcacaacctccggttctggaactactccaagccctgttcccaccaccagcacaacctctgcctctacaaccagcacaacttctgctcctacaaccagcacaacctctggtcctggaactactccaagccctgttcccagcaccagtacaacctctgctgctacaaccagcacaacctctgctcctacaaccagaacaacatctgctcctacaagcagcatgacctctggtcctggaactactcccagccctgttcccaccaccagcacaacctctgctcctacaactagcacaacctctggtcctggaactactcccagccctgttcccaccaccagcacaacctctgctcctataaccagcacaacctctggtcctggaagtactcccagccctgttcccaccaccagcacaacctctgctcctacaaccagcacaacctctgcctctacagccagcacaacctctggtcctggaactactcccagccctgttcccaccaccagcacaacctctgctcctacaaccagaacaacctctgcctctacagccagcacaacctctggtcctggaagtactcccagccctgttcccaccaccagcacaacctctgctcctacaaccagaacaacccctgcctctacagccagcacaacctctggtcctggaactactcccagccctgttcccaccacaagcacaacctctgcttctacaaccagcacaatctctctccctacaaccagcacaacctctgctcctataaccagcatgacctctggtcctggaactactcccagccctgttcccaccaccagcacaacctctgctcctacaaccagcacaacctctgcctctacagccagcacaacctctggtcctggaactactcccagccctgttcccaccaccagcacaacctctgctcctacaaccagcacaacctctgcctctacagccagcacaacctctggtcctggaacttctctcagccctgttcccaccacgagcacaacctctgctcctacaactagcacaacctctggtcctggaactactcccagccctgttcccaccaccagcacaacctctgctcctacaaccagcacgacctctggtcctggaactactcccagccccgttcccaccaccagcacaacccctgtttcaaagaccagcacaagccatctttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatacccgaccagccagcctgccaccggcctcacccgacgcccaccacggtcgggcccaccacagttgggtctaccacggtcgggcccaccacagttgggtctaccacggtcgggcccaccacaccgcctgctccgtgcctgccatcacccatctgccagctgattctgagcaaggtctttgagccgtgccacactgtgatccccccactgctgttctatgagggctgcgtctttgaccggtgccacatgacggacctggatgtggtgtgctccagcctggagctgtacgcggcactctgtgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctgccggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccccggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgccgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgcaa

SEQ ID NO: 155773 - DNA, 461 bp, Homo sapiens
  Payload ID: 10599
  Gene Symbol: MUC5B
  Gene Name: mucin 5B, oligomeric mucus/gel-forming
  ENST ID: ENST00000526859
  CDS Start-End: 1-461
cagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccaggaagctgcgacaggcaaggcggccgc
